United States Patent 12,746,261 (PROBIOTIC BACILLUS COMPOSITIONS AND METHODS OF USE) - sequence listing, part 10

SEQ ID NO: 14 - DNA, 1000000 bp, Bacillus subtilis
aacaagcatcatcaaatagacttatccgtgttctagacctaaaacgtgcatcatgttgccaagaaaatgttgcatttggctcaaaagtaaaatcgctttttttgccaccaagctgccagacaatctttcctgttgttttatcaaccaaataaatcgcccacatgttacgcatgcttattagaagagtattgttcggcccttcctcaactgaattcacgtgaaaacagtcccaaatattgttagcgcttgtggcggatgacgcaggtaacatcgagtcatccggattaacatgagcaagcacatcccagaagaaaagaagctctcctgtctcaagatctacttcttgaatggaataattgtcaaagtacccatctgccggacctccatacattgtgagatccgctggcacttgtttcacagcagtaaacaaagccgtatcttgctttgtaatcgtaaactcgtgaacatcagaggtaaatccttttttggcggtgagtttcttaatcactttataattctgattgatgatttgataaaaagctccaggttccggatcccccgccgggagattaggatcattagactgagttccagatattgttccttgccacatggtaagaacgggttcccctttgtaggattgtaccctaaagtccgtattttgtgtaaatctactatcaagaggtctaaaccatactgggttaccagcttgatctatgatcaatgcacctgtttgcccaatcatagttgcgccgaacacagtatagggtgcaacgaatattaagccgggtgctgtccctggcttgttgacatttatagaaaccttcataggatgcagggtaggagccgaaacaaagttccattcttgtgagcttgaatgatttgcggatgccttatcaccgcatcccccataaatggcacgcataattccgtatcgggacagaatcccgggttttcatcacataatgatttggcaaaggcaggattttgttggctgaggtttttaaaataacagacaatctcatgattgcgaacaggtaaactgttcagttgaaaagagagcgttaccttcttgtctacatgttgatagagtaatccttgctttgtaaatggaggcggatatgcttgatccggcaaggtgggaataatgtcatggatattgaaaatacgaatactattctttaccgtttggttgaaccgggacgcaaagacagggtcagcgactcgagggctgccataagtatacacaaaaggatttttaaatcgggtattcaccgcaatatcaaaagcggctaacacggctaaagctcctcctaaactatggcctgcgactaataatctttttgctgcataaagcttggttaattccccgatcagctcatttcttgtcgattgataaagacatgtaaatccacgatgggtttttcctgcatttctgacaaacggatatggtacttgatataagtcttggtccgactcattgtccttaaatgttcgggttcctctaaaaattacaatgatctgatcttgtgactcggcaataaaaccaaatacttcagcttccggatcctcaacaccagcaagagctcgtatggtatatcgaaggctatatccttttggcaagacaagcggttccttttcaaagagttgatatgactgatagatcatggccgatagcaatatcgaatcctcacggttaaacatataatataagcttgagtgattcatccgagcagctcctttcttttattcctagcatgttcctcgaaacggagtacacatgtcaggatcgggacaaaaccctggatttttatcgcataatatttcggagaaatcaggattcattttactaaggtatttaaaataacaagcaatcgcatcattgcgcggcgtattattcaattgaagagagattggatactttgtttttacatggtgatagtataatccttcctccgtaaaaggtggtggatacttttttgctgggaaagttggaaacgagtcatgaatatttacaattcgtatactatttttcaccactttgttaaattgggaagcaaagacagggtcaccgatacgcggactgccatacgtatacaagaaaggatgattaaacccagtgttcgcagcaatatctaaagcagctaacgttgccaaagctcctccgtagttgtgcccggtaacaaacagcttttttgacttagaaagtttatttatttgtctgattaaattgtttcttgttgattgataaagacatgtgaatccacgagacgttttcccgccatttttaacatagggatagggaacttgaaatatgtcataggatgctaaaagatccttaggatatgctgcgtatcctctaaacgctataacgatttgatcttgtgactcggcaataaaaccgaatacctcttccataggattctctacgtcagcaaaagcacgaatagtatatcgaagtttaaagccttctggtaaggtaagtttcccttctaaaaagaatggatatgtctgatagctcattgctgcaagaaatattgcggctttgctattaaaaatattgtttttatctaaagaaaccatatatacgcaatccctttcttaatataggtaaatatgatgttaatggtacaatatgaatgaaaacccggaattgctaatgatggtgatatgaacggggatatgggtaaagaaacgtggaagttacttaatgacggaataaaagaaaatgtaaaaagacaaaaagcgccctgttgcaggggcgctttttgattaagatgcatattgaggagatgtatcctcctttactgctttttcttcaggtatatgaatgcatttcgtcatgattgcactcgcaacgtaaaggaccgcaaagatccagacgacgccttgcgcaccgacgagaccgatgaacaaccaagcaagcgcgggaccgacaaacgctgataaacctgcagccaaattcaatacagacatggctgcccctttgtcttttccggccaccgtcggcacaattgccccgatcggcacatagcctgccagcaaacctccccaaataaagccgatcacactgacaaccgctacacttccgccggagaaaaccggtgcataatataataagacagtgaaaatgccgcagccgactccgccgaaccaaataacagtatttttccagccgaatttatcgccgacaataccaaagataagattaaacacaatgttccccagaaaaatcgttccccaaatttgcagccacacattggttgaaattccatgctgggccatgtgcatcggcaaaaagactggaaaaccatatgtaccaatgctgttgatgattctgatgattccgcctgtaaacacgcgcggatttgtaaataaaatcgtaaccccttttaaaagctcctcggctgtttctgatctttttcttttcttcttttcaaaacggtctttattgataaacaatgcaaagaatgcaccgagacatacccagaaaatagagctccaaagcgtattcaaataaccgaacgctttgatcgcgtagcttgagtaccaagcgccgaacacaaacatgccgaggcaatatgctatccaaaaccagccgacagcagtgctcagtttgctttgcggtgttctgtaaatgacccatgtcaagaaagaataagcaaaaagcgggtaacctaacccttttacgaagtaagtcacatacatcactggcaggttcagctgttcaaatccaaatacgataaaagcagctgtaccgatcacataaaacaacagccccataaacatcgttcgttttgcgccaaatgcttcgagacatacacccgaaaaccaggaagctatggcaagcgcaattccgtatatactaaaaatagaagcggactgctgaacggtgagcccgttttcgatcaaaaaaggactgagccagccttgttcaaggccatctcccatcataaacaaaacaacccctaaaaatccccaggcaagccgcttcggtattcctattttatccaacatatctgtctcctccttagatgcttatatccattaccgtattaccttattaaagttgaaaattaaatgattcctcaaaacagcaaaaatgctgccgccttaaatcaatactttgctttctgaacctgaaaaaaagcgctgtgtttgcttccatttctcatataaagccaattctgtctgacagtccttcggttcaatcacccggacatttgctgacatctcctccgttaattgaaaggtttcattgcaaatgactgcagcaccaacgacagatgcctgatgatatccctcttggacatagacctttttttgaagaagatccgcgatatattgagtgagcactttgctttggaatccccctccgcacacccaaacatagtcacgttcaaacggagtaacctctgttaaaatgtcaaagttccatttgattgaaaatgcgatttcttctagcgctgcacgtacaaaatgtgccctctttaaatgtgctgacagcggggcatcaaaaagaaaaccgcctctcgttaatgcattcttttcagccgataaataagagccgagagccgctacacatgcatagtcttcttttgcaagtgcagaaatctcctcctccattacttcgtacgtttcattcggataaaaaatctgttttaatttttgataattcaagccggtaattcccggattcgtttccacaagccaatgcccttgatctgtatgacagttcagccaggctttatgttttgtgtcgccatgatccgcagtaattttggttattggcgttgttgtccctgatacaatgacaatgtcctcaagtccagctccggtgcttttgacagccagctgtgtatccccgccccctgctataaccttagcatttattgaaaggcctaattcggatgcatattcatttgctatcgttccaattgctgttcccgctcttacaagaggcggaaggatagatggagaaaagccgaaaatgtcgcacatctcttctgaccaagtgttttgcttcacatcaaatagcagggtttctgttgcctgtgatggttcatatgttaatattccgctcagttggtacgtcacccaatcactgatgcttgtaaagcttgcagtcttttcccataaagagggctggcgctgttttaatccataaagcttgagcgcagaaaaaagtgcagttggcaggcggcctgtgcggctgtatatctcttcccgatcgggaatgcccgcctcccactctcggccgcgattatcgatgttcggcagcccgagaaaaggattgccgttttgatcaatcaaaacaatcccctgtctttggctcgtcgatgtcaaaccaatgatgtcaatatcacgcgaacgggatagcgcacgttttgccaaattcatcacctgcttccacagcacctgaggagaaaaataacggctgtccgggtaaagcgtctctgtggaatactcgatgtcctcccgttcaactgttagaacactgccagttacactcacgaccgctaccctcgcattgcctgtgccaatatcaaaaacgagatagcctttttgttttttcattctcttagcctcctttcttatacccctgttttcagttcgtccttgttatacattgtcggaatattaagagttttttcacccttccactttttgagggctttattcagtatcgtcacgtgatgatcctccacttcaaatgttgctccagcgagatgcggtgttgccagaacattaggcaatgaaatcaattcataatctgattcctctggaggttcatgataaaaaacgtctaatatcgcacctctgattttatgttcttttaatacagataaaagatcttcacggtttacaacaactgctcttgaagtattgacgaaaatcgcactctgtttcatcagatcaaaatgcttccgatcaataagtccaagtgtttcctcagtacgaggcagatgtacagaaacgatatcactgtctgaaaacaccgttttaagagatactttttcatacagcggatgatcgtcttgaatgtatggatcgtaatactttattttacagtcaaacgcagtcagcagttttgcaatcctttggccaaccgccccgaacccaatcatgccaaccgtttttcctgttaattcatttcctttaaatttgacataagcctgcaggtaatcactgttccactttccatccttcagccattgattcgaggcgctggtatggcgcagaaaggaaatcacatttccaataaacatttcagcaacggcttgtgcattccgccctggtgtataaaaaacaggtatgcctctttttgaggcagctgccacatccacattagagggcattcccctgcaaacaccgacaaatgaaagttcgggaacagaagcaaatacgctgtctgttacctgatcaagttcagtaatcaagcctgtcgcatttgttgcttttagcagctgaatgagttcatcttcccgatatgccctaccttgttccttccaagattgataagtaactgagccaaataagttttcaagctcttttcgtccttcttcgttgtacggtgctgtaaccaaaaccgtcatggtgcaaaacatccttttcattgtatttttcataaaaaaaatctctttccgaagatggaaagagattcatatataggcgcgctctgttacaggcagacgccggtataaaccttgctttcctatctttcaagctgacgcttgctggaattggcacaataatgttgccgaggtttcatagggccagtccctccacctctctggatagaaaatgttgagtatgtaattttcagaataaagaatacgtttatcataaagaagtctcagattgatgtcaatctcttttttcagaattgacgttatgatccgaaatgttataattcttacaaaatatctaactagagagaggaactgggccatgaaatcttttgccacacaacaaaacggcattttcaaatccgtttgctcgctggactgcccggatcagtgcggattgttaatacataaaaaagacgaaaaaatcgtaaaagtgcaaggagaccctgatcatcctgtcacagccggaaacatatgcaacaaagtccggaatatgacggagcgcatctatgatgaaaagcggctgactacaccgctcaaacgaacaggtgctaaaggccaagcgatatttgaaccgatttcctggaaagaggcaatcgatacgatcacctcccgctggaaacagctgattgatgaagagggagctgaaagcatacttccttacagcttttacggaaatatggggaaattgacagctgaaggaatggaccgccgctttttttaccgcatggggtcaagccagcttgaacggacgatttgcagcaaagcgggatctgaaggctataaatatacaatgggcataagcgcgggaatcgatcctgaggaaaccattcatacaaaactatttattttttggggaatcaacgcggtcagcacaaatatgcaccaaattacgatcgcccaaaaagcgcgaaaacaaggtgccaaaattgtcgtgatcgatgtgcataaaaatcaaacaggacgtctcgcagattggtttattccgataaagccgggaaccgacagtgcacttgctcttggcatcatgcacattttatttaaagaaaaccttcatgatgaagcatttctgtctgagtacacggttggctatgaagagctccgtgaacacgtgaaacaatatgatcctaaaaaggtatcgacgatcaccggtgtcagtaccgaagatatttaccgactggcaaaaatgtacggggaaacctccccttcttttatcagaatcggaaacggaccccagcatcacgataacggcgggatgattgtcaggacgattgcctgtcttccggcgatcaccggccaatggctgcacacagggggcggcgcaattaagcataacagcggaattttagaatataatacaaatgccttgcagcggcccgacttattgaaagggcgcaccccgaggtcgtttaatatgaatcagcttggcaaggtgcttttggaaacagacccgccgattcgctctctatttatttacggaacgaaccctgccgtcgtcgcacccgaagcaaacaaagtcagacagggcttgctgcgggaagacttgtttactgtggttcatgatttgtttttaacggaaacggctgcatatgcggacattgtactgcctgcaacatccgcttttgaaaatactgatttttacacctcctactggcaccattacattcagcttcagcagccggtgattgagagatatggggaaagcaagtctaacactgaggtgttccgattactggctgaagccatgggattcacagaccaggagcttaaagattcagatgaagtattaatccgccaggcgcttgaccatccagataatccgcatttggcagagattgattacgatgcactcactaagcattcatttatgaaagcaaaacgcgaaaagccgctgtttccgggcgaacttccaacgccaagcggaaaaatagaattatattcagaaaaaatgaaacaagacggcttcccggctttaccgacatatacacctcttgtaaccgataatgaacatccgtttatgtatgttccggggccaaaccataatttcttaaactcaacattttccaataatgaaaaacacatcaagcttgaaaagacgccaaagctctttatcaacacaaaagatgctgaagaacacggaatcgttgatggggcacctgtacgaatttggaacagccggggagaatgcgagctgaccgctgcagttggagaacaagtgctgccaggtgtcgttgtcagccaaggattatgggcggatgaacaaggaaaaaaacagcttgtaaacgcgctaaccccagacagattgtccgatatgggcggcggcgccacctttttttcaggacgcgtgcagattgaaaaagcataaacgaaaaaaccgcccagaacatgttctggcggtttttttttggttgataatgaaacccggagtatgccaagcccgtataacataacatcgacataatggaggcatgcatatggacgtttttttaggaatcggtattgctttggctggctattttatcggtgaaggcttaaagcagaggaaccaaaccaaaggtaatgaacaaaatgatatcttcctaataaaagaacgggatatttacttttacattggactttttttaggaataacaacgactgaagcaaaacagttagctggagacatggcagacctgccttacatcgaaataaacggaaaaaaatatgtccagaaacatatgttaaaagattggacattcacattagttgaaaaacatcagggtgaataaaacaaatctgaggagagcgagattcattgtcacgacgctctcctctgtttagctgtatggattgaccgccaccaaaactttgttctataagcgctgataaaacgataaaccaccatctatgttctttcctcaaacaactcaagatgcccgttccacaacaatagtttttatattcctttgatgacgtgatgttcttgatgaacgtatgtatcgtaaaacacttagaaaacctattcggtttgaatgtgtgctctcattatgcccccatactgcgcctttatccgcggaggatttttttaaaaaaatatgaaacctaaagcttttagatcctgaatttttattgaacctccatatttctccgattggtaaaaattagcctatacaccggaagctgtacgtttataaaggatcagagaatcccataaccagtaaatcactgcagccgcaatacttaacatataataaaagtacgattgcaatgtccatgctattgacgcaggttcattgataacaaaaaacaggaaagctgcgataaaagcaaccacactgtaaatcaataggtacatgacattgaatgttctcgcttttttctgcaacttcatttggagcggaacagcaaaaaggccatacaccacaaaaccgtataataaagcaattgctgccgtaaacaatgcaattatcatatcgccatacataacgaaagaataaaaccctaataacaaaccaaatgtaaggctggatagccctaatgtcattaaataatatgatgcgatttttttcattttttcaccccccttgtttgatttattcacagtgctgttagtataaattcacaacctttgtattaacaatgcgatgataaaaggtttcaaaaatacgactttttattaaataatacgactggcatgaaaatgcctctcctgattagccaaagcgcgaatgaaaaaaagtgaatgaatacctgatcaacagacaaaataagaagagttgatattcaacacttttcgtaaaggagtgaaaccaatgagtaagaaaggtattcaaaattcaagtattgaacaaataagaaatgaccatgagactgaaacagcttttaaagcagatgatcctaaaaaacacggttccgatcctaaaagaacgaaataagttcttacccccactaaaatatcaataatctggaggaagtaaagtgactcaaaaaaacggtgcagacagacctgatgattataaaagattttcttcattagacaaggaatatgattttcagcaatctatacgcagcaatactgagacagaaagtgtaaacactgaaacacaaactcataacaaagaaaacaaaaatgacacaacagatgttgccgggaaatactttgagccctcagattataaaggaagcacgcaattagaaaaaggattggctgaaactcatgaacaggtgagcgatgactattttgaagggacaatcgatcaaaatttggactagccatacaaacggagctacttaaaagaagtcagttagctccgtttgtagaaacaaccacagtaaaagtagccaacccccaccgaataagatgggggttgcacgtaagtagcctgtttaatagttaaaacgattaatgacggtttgaagttcttccgccaattgggatagagattctgcagcataggagatttcctccattgaatgaagctgctcctgtgaagattttgcaaccgcttctgtatttgctgacgtttcttttgtaccagcagccaatgtatgaactgtgtgctgaatcacttcaacgcctgatgtaagctgttgagttgccgctgcgacttcttgtatttgagaagtgacctgttccacgaggttcagtatttcattgaaatttcctgttgcctcttgagaaagaacaatacctgagctcacattttcttgaacaaccttaatattatttaccgtttctagcgattcattttggatggtcgctaccaccgattggatgtggtttgcagatttatttgtttcatccgccaacttccgaacttcttctgccaccacagcaaatccttttccttgctctccggctctggccgcctcgatcgctgcatttagtgccaacaaatttgtctgctctgaaatcgtcgtgataagcgaagagatatcgctgatttctgctgtgctcgctaccaatgtctgcaatccattgccggctgaatctacagatttatctatgaatttcatctgatctaacatcttgttgacggacttagagcctatttcagccttgtctctcatcgaagaagaaagatccgctatgttccctgtatttgaagcaactgatgatatactgtctaataattcagtgatggattctgcgctcttttctgtcattgagctttgcttcacattgctgtcggcagccatctgcatggctcgggaaatatgttcagatgttgatttcgattcttccgcgcttgccgataattcttcggaggaagcggcgacttgttcagatgagctgctgatctgcttcacaatttgagttaatgaatgagtaaaagaattaaacgattgggcaagctgaccaaattcatctttatttttcacaatgacttttttggttaaatcagcgtcgccatgagcaatttcctctagctgcttatttatgcttcttagtggcaccataatggactttaacagcattatgcttagaacaatgcctaatattactgatatccctgtgacaatgataatgagcgattgactcattttcccattgccctgtatttcatcctttagatcctctacctcttgatccaggcgatcagacagcttattgacagccggatctacgacttcttttcttaatgttctttcttctccaaaatggatggtttctgcttttttaggatttgaagagtaggctgttactacctgctgattcaaagctctatactgagtaaaacttgtcttaatgtcttcaatattggattgatacttctcttcatcaatcaagtcattaacccggtcaaggctctttaagacatcgtctgctttttccttcataccctcgtcgtattctttgtctccggtaatcaagaagcctctttcatcatttgataacccggtcaattcatattggatgtgttttatctctttttggaattccattttgtctttaagttcttcattctttttcacagtagaagaaatcataaatactgaggagcctccaattccaataattgaaacaactaatattgatataatccccagcaattttgttttcactttcatgtgtcgttttccctttccgcacaatgtaatggctgaaataaaatatgttcaagcgcgtttgaatccaattcgcttacgctcatgtccataatatcgacacgtgttatcaagttttatagtgctattttcatatgaataagctaattctttacggctctaaatcttcagaaaggcttcacgaaaaattgactgtcttttgtcgtataagtcactcttattctcattttctattaggcatacaaaaaaggcttttcccacctcaaattggctgaaccggctgttttctcgaaaatataatacaatacgcagcataatatgaaggagcgaaacttaaatggggatcatcaatggtaaagaattcattgaccgattgaataaactagaaaacgaaatatggtatgatggcgaaaaaataaagggtaacatttctgagcatcctgcatttaaaggaataatcaaaacaaaaagctcactttatgaattgcaaacaaaggatgagttaatacatgaaatgacttattgccttcctggagatcataatcgaatcggcctttcctatctccagcctaaaaccaaaaatgatttgaaaaaaagaaggaccatgattgaacattgggctagacatactcatggaatgatggggagaagtccggattacatgaatacggttatgatgagctttgcttcgtcagcggagcttctaaaagataaagagaattgctttcctgaacatatactagatatgtatgaacaagctgctaagcatgacctttcctttacccatacattcattactccgcaagtgaaccggtcacagtcctattttgggctaagtgaaaaaccgatatctgctaaagtcattgatagaaccgaaaaaggtttaatgattcatggcgcacgactgcttgcaacacaaggcgggttgaccgatgaaatcttggttttttcagcgcctaaatttttctttgaaacagatgaagcttatgctttttcaatcccttctaatacaaaaggcgtaaaattcatcacaagagaatcatttgtattaagcgactcttcctttaatcatcccttaagctcaaggtatgaagaaatggattcaattgtggtttttgatcatgtgttagtgccgtggaatcgtgtgtttttttacgataatgtggaagcagctaaagattttatgacaaaaagctcttttcatgcctttacctttcaccaggttgtcattaggcaaatgataaaaattgaatttctattaggtgttgcacagcttcttgtcgacaccattaatgtttccgaatatcagcacatccaagaaaagctctcagaaatcattgtgggattggaaacaatcaaagccctcattgacaaatcggaaaatgatgctcagttagatgaattcggctatatgcgcccctgtttaattcctcttcaagtcatcagtacgatcattcctaagctatatcctcgatttactgaaatcatacaattaattggagctagcggaatggtgacactgcctaccgaaaatgcatttgactcagagatacgggaagatcttgaccaatatcttcaagcaaccaatacaaatgctgaagaacgtgtgaaaattttccgtttggcatgggatttaacaatgagttcattcggaactagacaaactcactacgaaagatattttttcggagatcctattcggatttcaagcaggctgtataccagttatccaaagcaggagcagttgaacatgattaaaacatttttacatgcagatacagaacattgaaaaaacagcgggaaaagatccgctgtttcgtattttttattcaggaaactgaacatggcccggtactgtataggctttggacgttccgctttcaggcagctttggaatggtgtctttcacaacttttccgcggatgtcagtcattctgactttgagagagccagtacctaaattcgtactcacaaaatggttatagtccattttctccatgttgatccacttaccatccttttcatattccattttcataacaggatacttgtgatttctgacttggattgctgcccaccacctgctgctgccttctttgatccggtacgtgaaattgccggtgattggggctttgacaacacgccatttaatattgatttttccgtctttcatattgccgattttacggaaggcattaggtgacagatcaagagctccccgagcgccttcgggataaagatcagtaacatatacggttgttttcccttttggcccttcaacttccaaataagagccggcaagtgccgcttttactcctccgtaattgagatccgccggatttattgcagtaatctccatatcggaaggaatgggatccagcaggaaagctcctcctgaataacctgaccctgtatacgttgcataaccttcatgcaggtcgtcatatgctgccgaagcttgcggggaaaaacagaagatcgtcaacaaaaccataccaacaaatgcactcatgatctttttcatatttggtcctcctcaaaccagactccaaatgagaatcattatcattataagactcaatccatctggtttgaaagaggaaatagattcatagttgattttaaggcaaattcactatcattcatatatcaaatgtaggtacttatgaaaaagccaatacaaatgaacgaatgtgcacttcagccgaatgtcttatttttccctctcaaaattcgcatttcaataacgaaatgaaacaggctgttggcctgataacagctatacaggaaaagctatttttccccgctcagtttcaacttagctgtcatcatgatgccaaagatcagcacaatcggaacccaaataatgaagtgataaaaatcaggctcagccagagcaacaataatagcccctacacaatacaaaataatagccagtgctcttaacacagtatctcttaagaaagtcttcttttgcttcttaaaaaacaaacggccggatatatcctctaaaagagaagccaaagtgccggtcaacacagttgaagaaatacctgcaatccccagtttttttgctgctgtagtttgaatccccatagaaatgctcatgagtataattagaatgtgcacaggaacaaatgcccggtaaaaagaaagacaagcaaagacaaacaaaatgaatgcttcaagtgcgagggcttttgtcacagcagaaggccaaagggtattttccgcctttccgaccatcaatgtagcaatgatcacgccgcatataaatccgattagcgcagtcaaggaattaaaaacagtgacttgaatggatttgccgatagctaaccccaataatacaatgtttccagtcatattagctgtgaacacatgtcccaggcttaaatacccgattacatccacgattccagctgttaaacataaaagtgatagcaaggtgtttcgataagctgctgcagtcaacggtgtatcaatcctttcttctatttcaattgttagtatgtcttttggcgcaatctctattttttaagtaacccaacattaattaggaagatagaacctatcattcctttccattaactgtaataataatccccgcaaggaaatgattaaaattgaaaggaagcatattgtgatgaaacgactttgtttatggttcaccgtctttagcttgtttttggttctcttgcctggaaaagcattaggtgcagtcgattttccgaatacctcaacaaatggccttttaggttttgccggaaatgccaaaaatgaaaaaggcatctctaaaacgggcacaacgggtggaaaaaacgggcagattgtttacattcaaagcgtaaatgatttaaaaacccatctaggaggatccactccgaaaattttagtgcttcaaaatgatctttccgcatctgcgaaaacaacagttaccattggctcaaataaaacactcgtgggctcttacgcgaaaaaaacgctgaaaaatatttatttaacaacttcatcagcttctggaaatgtcatttttcaaaatttaacgtttgaacacagtccgcagattaacggaaataatgatatccagctttatttagattccggtatgaactattggattgatcacgtcacattctcaggtcatagctataatgcaagcggaagcgatttggacaaactcgtgtatatcggaaaatccgcagattatatcacgatcagcaactcaaaatttgcgaatcataaatacggtttgattttaggatacccggatgattctcagcatcaatatgacggctacccccacatgacaatcgccaataattattttgagaacttgtatgttagaggcccaggtctgatgagatacggttactttcatgttaaaaacaattacagcaataattttaaccaggcgattacaattgctacaaaagcaaaaatatattccgaatataattactttgggaaaggcagtgaaaaaggcggcatccttgacgacaagggcactggttatttcaaagacataggcagctatccatcactcaacaagcaaacctctccgctgacttcttggaatcccgggtcaaactatagctatcgtgtccaaacgccggaatatacaaaagaatttgtcacgaaatatgccggatcacaaagtacaactctggtatttggctactgatataaaagaggccctgcgttaaaaacgctgtgcctctttttatacttataggctatttttaagcgatccttgtaactccatcaagatccagcgtcggtcaaaccaaaaagcatatgtttttttccgcaataacttcttaaatggctttcttattataccagtttatcgcaagtaaaaagaaatcattgttctggtcctgtattaaatcaacgttcgtcccacacactattcaaaaacccctaaaaaggatgatggatatgtgcggcaggtttactttgtactctgcatttgatgatattattgaccagtttgacatcgatcaattttttcctaaaggtgaataccagccaagctataatgtcgcaccatcacaaaacatccttgcaatcatcaatgatggatcaaataatcgcttaggcaagcttagatggggacttattccaccttgggcaaaagatgaaaagatcggttataaaatgattaatgctcgagccgaaaccattaccgagaaaccggcctttcgaagaccgcttgtcagcaaacgctgcatcataccagcagacagtttttatgaatggaaacggcttgattccaaaaccaaaatcccaatgcggatcaaattgaaatcatctgctctttttgcgtttgctggcttatatgaaaagtggagcacacatcaaggataccctctttatacctgcaccatcataacaactgagcctaatgagttcatgaaagatatacacgaccgaatgccggttatattggcccatgatcatgaaaaggagtggcttaacccccaaaatacaagccctgattatctgcaaagtttgctgctgccttatgatgctgatgacatggaagcataccaggtttcatcattagtaaattcacctaaaaataattcagctgagcttcttgatgcagaaaatcatatgtagtgattgaaattctctagcaagaacttgtcaatagctttgttccttaggtgccaatccctctagtaattatgaatatttagtacatagatcaattagttttcgatatcagttcgaaataattttattatgtaaacttaaataagcaatgttatccctttcatataaaatagtttacatttttataaagtcgcttcacctttctattttgtcagcaaaaaaactgaaccacattaaacttatgaaacctgccgcacctgtgattgcaaatatgatataagcccatagaggtaaatccatacactttccatcctaagaattaaatgaaatttctttcatcttacatgaaggtcttctttcttttgtttatccagtgtaatacttaataatatgttgatgaatgcagctggaaaatatataaatcccactccaagaatgcctagtatcgtacttaaacttactatgtaattctttgtcatcgtttgactgtcaatcaatattagaagtgaaatcaatccagctaaaacacctataaaccaagcatcgccaacagcataagaatcatccagcatccctaaacatcgccccaatatagagctcccaatggcagtcaaactggataaaaatatgagtgctttcatttcttctcctcctttaaagccaatcaaactggtagaaatcggccattgaattcccattatcgaatggttatcatttccacattaacattttaaagctcattacaatacgattcaagcagaaaaaccctacataacgtatatatagggatttaataaaacacaggccaaaattcagctctatctactttaaaaagatatgaagggcagctgtgtgatctgttacgtctttacgtaccgagatatttcacaacaggcactttcttcttgcgcagagaatcaagcatgactgatccagcattcaagttgctttgtactaattctttaggcgtcaatgccatccactgattgagtgacacatctgcatagcggttacttttgaacatttctaaaaaccataatgtttctgtaccagtgttttgtatatagtgtccggcattagaaggcacgtatccaacgtcgcctgctctataatcaaatgtgcgggcagtcccatttccgataaataccgtcattcgtccctgtcctgttagataatattgccactcatcgctattgggatgccaatgaagctctctcatcgcgccaggctcaatctgaacaagtgcagcggctatcgtttttgaaattgggaagttagaagaatccacaattcgtacactcccccctggcatttgaattgggggttgatttaacagctcgtgtttaaaggtcatggggacttttccatatggtgactgaatgtcttcactggcgactgatcccggcacattcccttggtagatatagacttgctcagacggaagagagttgaaagcattctccgggacaccgaaatttgcagacagaacatcttttggtgtgtgtgcaagccaatctgaaatggttaacgttgaaaactcagaaaagttcccatcatcgaaaacgagcagaaactcgcagtgttccaatccctgtatggaatgcggaattcctgccgggaagtaccaaaggtcgccgggaccaacatcagcaatgaaatttcgtccgtcttggtcaacagcggtgatacgtgcccgtcccaaaagcatataagcccactccgcttgcttatgccaatgaagctcgcggacgcctcccgcagttaagctcatgtttacacctgcaatcgcagtcgaaatcggaagctgtcttacggtgatttctcttgaccagccgccgtgatctaatttcatgggagcgtctgagaatgaaaatctcaagttaggaatcataccctcatctgtaacaggcggaacaaatatattcggattttgaatatcccgtattatatttcgcgggcctgtatcaatagctccagctccatcacttcgaataggctgcggcacgtttctgtcttcatgattgattggttgttgttccaacagcatgcacctcgttttagaaatgaacaagattttatttcagcctatgcagaatcttagattgctgtgcctaggaatccgcaaataaaaaagtgaccaccaatgtgatcacaaatacatcaaataaactattttttataccatggcttcttatgtaatttgattgcttctgtctgttttttctggcctgtcctccactccacttttactaatacatcatgtcctatcacttcatcttcaggcatataatcaaaggtggaaatatggtcctccatgcgtcccccacccggcatttcatcacctgtgtactctgataagtcgtactcatctacgttatcatcttgatacttttcgccatctacatacagagtaattctttcaacaacagtccacttttcttccttcttactcccctgccaatatagatttagaaaataattgggtccaattgaagttttgtctgatttttcaaggttagacatccacagtccgcttttcccgctgccctcatatttcactttgtttcctgacaccattacaaataatgtgatgatgcagatgatcaagaatccagcaatgatcaatagccatttcttaatattgttcttttttctcatgtttttcctcactttcctaactttttagtaggaaaatacgatcaaaatgttaccgaaaagaaaataaaaaagggctaatgatctaacagatgactgtctaaacttttgacttaaattaaagtgctctctaaagacaagattaaaacgtataacagctcttaaatgcattttttgtttcattgagtcaagaaccttaaaatggctttttattattaaaaatcaagctagtgtattaagtaacttttcaaatttatttatactcatgatctcgtgagtcacaaatcttccatcaaaaaaaacgctaaaagttgtccaaatagctggtgacttttgtgcctcttctttcgatgataactgaattgactgaaattgaacccctttcttttcagtcaattcccgcaaatcatttatcatgcccactgcaaacggacactgagctgtatagtatatcgtaatccccttttcattgatagaatcacttttcacctggctcttaaatgcaggagaagctgcaaggccattccaagtcaaagccattaattgaaaataaggggcagcttcatcttgtagagtaaaccccatatgctcaaagaaatgcttatcacttaaatagggcagttttttcttgcctgcgatatggataatgccatccatgccgcacgctttcgcatctgctatacatttgtccaacaatcgtttcgcatgaccgttatttttatatctgccagacacccacagacaattaatgtacataaaattaggcgcattgataggcacccatgcctcattcgcaggtaggtattcaataaagacttttgcccgttcatgtaagcgatagaacaccaatccttcatccattcgagctttgagccatctcttcttttcattaactgcatgctcatattgtttcgtgcctaatgcacagcaaatatgattgtcttcaatattgtcctttgtgatttcaatgtagcacatctcctcttttccccctttaacataattacatggaattcaacttcacactttacatgcctaatagaataaatacccgttccaacttaaatactttttcttttccattttgtcaattaactgtaaaactcttcttttattcagatattatcttgattcctatatcacccatttcaaatccaaagtgtgttcatctttgaggattagatgcactgcttatgctataaatacagtacacgaagttttttatttgaagtaatatttgttacgggacagcaatagtaaataagtgataaaaggggaattaaacttggtggaaaaatgttattcttgtttaatttgcagatacaaaggattatttcaaaatcctttgtataaaggcgattatcaaaaaacgtttgacatttgtccatgttgcggttttgaatttggctacagtgaggatcatgatgtgaggttaggttttattgtaactcctgatcatttaattgaggctgcatttcaattgtatcgcaaacaatggattgagagcgggatggtaattgctcatccggaagatattccagaagaattgaaaaatggcaattgcttaaaatttgaagttttgttgaaacaattgaaaaaactaaatcttgacatagaaaattttgaaattagcggtttttaatgatgaaacaggttgcacttgtttaggtttcactgtcattatcagtaaaatgttaagttgaaatgcgcagtcagtcacaaagtctctattcgtattcaataaagactttgtgatcatcgacaaacatttcactcccatcggataaagtatccaaaaggcctcctctggttcttctctatagtcattaatcacagtcactttgacatttgactcagctatgattggttttccaacaatttttcgttttttcctcaggcaaagtaagagatcgaatcatcaaagccattccatctttactgtctaattaatgccatcttcagtgaatttaaaggtctgttttaaattgcgtccttcttgccccttctgtgtccaaattataacaacctctaattcagaggccttatctgccagcataaaatgattgaacttcagcggtgagccatcatttaaactttcagctaacattttagaatcttcttttggtttgacacaattttcatcgggacatccaaaaagcgaaaaccttgtgattgaattagggtcatttctatacaattgcacatccactgtagctgctttttcccctatatttttgacttccaaggaatatacttgatattctcctttttgaggtctcgtaaattcctttacattttttgcttcacttacttttactgaccactgttctgttttttgtgtaataggcaacaccgtaaaagtcagggcatgcgcttttgattggcaaaacgtaaatccaactgctgtaaaaacaattacagaaaataatacccttttcacttcatttatccctccttcctttcactggccgctccttaaagaattgattttgagcaatctacaagctctcttaaccaaaaccttacctgaggttttgtctttactgctctgcatttatttctttcggtatccgagaaggagctttggggatttttctcaatctgctgttaatcacatcagaagagtatagcgtaataatcatacttctcccatacctttttgcccgaattaagattggttggttatattggttttgaaagcgaaagtcaggacctccccagcttaccgtcgcatcccgtccgggcggtacatatggtacacttctagtatgagaatagcgctgaacgatctgcagtcctgcacgatctactgcattaaatagagttgaggacacctgacaaattcctcctcctacaccttcagacaactctccttttacaataatgggtgcacttttatatcctttgttccgagttctcattcccacaacttggttaaacgaaaacgtctcattagggaaaacaacgtgattgtcgattgcttttgcagaaagagaaatattgtgtgaacggcttttattgcttgagttaaaatacgtcacgtactgaccaagctgctgcgtactgatgtgagctagcagctcgctgtcaactttcggataaatgttcatttccggcacttctatcttggagggaccttgcccataaaaatacgcataaaacttttccataaacgcctgttgatacagtttgtagccaaccctgcccgggacgatgcttccatgatcgttaaggacagcatttatcggctcacggtacactttctgatcaagctgtttgatgaatttactgtatttttcatagtcaaccattggagtgccgggaagaggcattgtaaagtcttcacggttaacagtggcaatcgtccgtccttgctgtgtgaccgttaaactgtcctgcggctcactcggctgagccaataaaaaaagaccagtgatcaaaatttgtatcataagtcggtttacctcccaatcattagtatgaacagccgcttatcctttgatgtatttcttcccatcgtttgtttgaatctttagacgttgataaaaaccttcataaaagagcttagctttatgttcacaccgatccctgagctcactgaggcacacggttcattcagtcggcaagtttgaagtagttcagcatctcccagtgatgagggatgcttttttgtcttgtcaaaaatgaaaagggtctcctataacaacaaaaaatcaatccatttcaatatttttttattgagaaacgataaattttttgttacattcaattagacaacaaataaatgaggtgcttgttatgaatcgaatgtcgacaatttttttaaagatagctttggttcttattggaattccaattcttgctttatgcatttttttagtgcctaaggtagccaactattcagcagaattatttccaaatatcgcttatataaaatatctcgttttcatctatttgtatgtaacggcgatacctttttactttgctctttatcaagcgttcaaacttttaagctatattgacaaaaacaaagctttctcgggtttgtctgtaagagctttgaagaatataaaatattgcgcagtcactatcagtatcttttacgcagcaggcatgcctgtcttttatctgatggccgagatagacgacgccccgggtatcattgtgatcggattggttattatttttgcttcaatggtgattgcggtctttgctgctgttcttcaaaaactgttaaaagaagcgattgatataaaatcagaaaatgacttaacggtctgaggtgatgacatggcgattattatcaacattgatgtgatgcttgctaagaggaaaatgagcgtaacagagctttcagagagagttggcatcaccatggctaatctttcgatattaaaaaacggaaaagcaaaggctattcgattatcaactttagaagcgatttgcaaggctttagaatgtcagcccggggatatattggaataccgaagtgatgaagacacaggattcgtaaagaaaaaatatgaaggatcaacagaaaaataaagtgattggcggtgagcttatggacataaacttatatccatctagctgctatactaagcgtccctttcatacacgaagaacacaactatggaggaggcatacatcatgagagccataaaacaaatcgttcattttggctgggaacaagccctttcatgtttgtttcctgccgttatttttgcctctttggctattacgcaaatcatcccactgcccttcttgccgcggtatgactggctgctcattatctgcgttctcatgcaattgtggatggtgcgttccggtcttgagacacgggatgaattaaaagtgatcacattattccaccttattgggcttgctctggaactttttaaagtccatatgggctcctggtcttatccagaagaaggatactccaaaatatttggagtacctttgtatagcggctttatgtacgcaagtgtagccagttatttgtgccaggcatggagaaggcttaatgttgaactggttaagtggccgcctttttttgcagttgttccgcttgccacagcgatttatttgaattttttcacccaccatttttctatagactttcgatggtggttatctgggcttgtcatcattgtcttttggcaaacatgggttacatacgaggtgaatggagctcgttaccgtatgccgctcgcactttcttttgtactcatcggattttttatatggatagcggaaaatatcgctacgttttttggagcttggaaatatccaaaccaaatcgatacatggagtctcgtacaccttggaaaggtaagttcatggctcttgctagtgattgttagctttcttatagtagcatcattaaaacaagttaaggagcagagtcccacaaaggcagagatggatgaatctttttcttagcatacaaggtcccaaatagagtgaaaagcaacgttcaaatggttgcttttttcttttatgtaactctgccggtgagtattcatcttcttcaaatttcatcgcaccacgataactgattcagattacaactgctttcaacacattgataaactcatgcgccgccggcgttatctcttcaaatgaatgtacgatgacgccaatatcgcgtgtgaccctaggaaagatgtcctttttaatcaattgatgcgggacggatgaaagtgtaaagtttgaaatgatgccgatacccaagttatttttgaccatattaatcaaggtttcggcattttgcacagttaagttttcctttaattcgatgttgtattgcgaaaatgcgtttgacatcgcgatttcatgaccgcctttacaaaaaatgaggtcatcttgatatgtttcaaggtcgacatgcttttcaagttttaattcgtcacgctgcggcgggatgacggccaccatatagtcgttacacaatagctgattttcaaacggttcaaatggagatgctgcgattccgatatcaaccgtccgatcctcaacccatccttttatttggtcagaggttccttcgatcaattctatgcggatcagcgggtagtttgatctgaatgcagcaatcgcctgtggcatgatatttgttgaaactgcaggaaatgaaccgattttcaccttcccgtttaacagcttgttttcccggttggctacttgatatattttgctttcaattcccttcatttgcctcgcaagcagcaatatttcttttccgatgtcagtcagcattaaaccatgatgtttatccctgatcaataatttgagctgcagtgagctctccaggttttttatcgctttgcttaccgccggctgagagatgaacaattcttttgccgcttctgtaatattcaatttctccccgacttttacaaatatgtgaagatggttcatattcataaccatttggttatacccccaataataaaaatgtatttcagttatacataaatgtaacatatgatagaaaccagcacgatatttaaacaagaaaggcggcttcattatggtaaaagttatgctgggaatcatatctgtcacacttatttggggttatacttgggttgcgatgaaagtaggaattcatgacatccccccgcttttattttcgggtttgcgcctgttcatcggagcagttcctttatttctcattctcttcatccaaagaaaaaagctttcaataaaaaaagaacatctcaaaagctatatcatcatgagcctgttgatggggctgggctatatggggattttgacgtatggaatgcagtttgtcgattcagggaaaacctctgttttggtatatacaatgcctatatttgttacggtgatcagccatttttcattaaacgagaaaatgaatgtgtatagaacgatgggactggtctgtggcctcttcggactgttatttatatttggaaaggaaatgctcaatatcgaacaaagcgctttatttggggagctgtgcgtacttgcggcagcgcttagctggggaatcgcgaatgtgttcagcaagctacaattcaagcatatcgatattattcacatgaatgcctggcaccttatgatgggagccgtcatgttattggtgttttcctttatatttgagccggtcccttcagccgagtggacatatcaggcggtgtggtcattgctgtttaatggcttgctttccaccggctttacctttgtcgtatggttttgggtgctcaatcaaatccaagcgtcaaaagcatccatggcattaatgtttgttcccgtattagccctattctttggatggctgcaattgcacgaacagatcaccatcaatattatcctcggcgcactgctgatatgctgcgggatttttatgaatacatttacattttcacgacggaaagtgtgaatgatatacatttcccctgtcatttgggcttcatgtgacaggagacgactattacgagaaagtcttctagaatcctgacgacagcctattaaacaatgaaaaaagctaatgtctgcatgtagacattagcttggctggcgtttaggctggtgagaatccagatacttttttattaccattctggctgatcaaactgaaaaccgtatagaccttttactttaacatctccgcaatctggatcttttgtcaaaatcaaataatgagtcttataaggcatcgtctcaactcgatcagttgcactcaaatcaaaatgatcccctgagaagtttttttcactaacggttatttcatatcctgacaaagtcattcgcatgattcttgcgttaattgtacatccttcagtatcgaaaatggtgaatctgtacccaaagtgagatgtccaatggtttgaatttaggtcatcagacttcataaaccatttttcattttctgtcattgtaaaactcactttctcctcatctttcacgataacagccgaagcttcccctacatggatagtcaaagccaaaagaaatgtaaaagctaacatcaacatctttttcaaaagagttcctcccgatatctttttacttcaatttattggaagggtcttttctgatcaagacagtcttctccaaatgaatctttagcatcatgaaatgagccttaataagaacagttttaacccaaatcaaactctattcgaaataaggcttaccaatctatattctttttaaaagtttctgcatttctttatatagctcctagacacatataaaaaatgctcccataagttcaggagcactacaaaaaactgctaaagtgttttctatcgatttattgtattcattagctcaaagaagtattcaggcttataagtcttattcagcttataccatgaacgcaatgtatctggtgcaaatacttctaattttttcaatacttctaccgcaaattccagaggagcaattcctgatgcagtaaccaaattttcatcagatactgcaggttccttttcatatagtgtttctcctttgtaattagggcagaccattttcatatactctaggtcattgcttgtgtgctttctcgaatttaagtatccttcattcgcgaggcccaaggttgcaccacaaatcgcagcaatagtcgtgccaagctttaaagcgtcgccaacttttttcaagatcggctgatgaatatcttctccccaagtgtttcctccgggtaaaatgataagatcttgactctcaagagtacactcatcaagagaaatatctggttttatgcttaatccgcccaacgtagttatcatttctttattagcccctactgtaactacttttaaagatgctgcatcctgtttaaaatatctccctgagtttagttcagcaattaaatatccatattcccagtctgacattgtgtgaaatacgtagagataaacttttctcgtttgcatccaataacactccaatcacaattgataaagctttctaatagatgactttgctgacagccattgtcagcatatgtattctgatttgcctattcttatataataccatgtaggtgggcaattgcccttgttctcccaacttattaaaaatataagataaattgattctatgtttactagcgcaaaggggtttgttacactaactgtcatgggaaacatttcaaaggtaatataaaatcatttgaatgaggaggcctgatgaagttgaaaaataaagcgtcaataaaattcggaatatgtgttgggcttttatgtttaagcattactggtttcacacctttttacagctcaacacatgccgaagcaaaatccatagaagacacaaacatggcaagctgtataacgaataaaaaatttgttcaacttgagaaaaaatttgatgccaggcttggtgtttatgccattgatacaggttcaaacaagacaatcgcctatcggtcgaatgagcgatttgcttacgcatcaacctataaagttctagccgcagctgctgtcctgaagaaaaactcaattgaaaaacttaatgaagtcatccactacagcaaggacgatcttgttacatattctccaatcacagagaaacacctagatacaggcatgagcctaaatgaaatctcggaagcggctatccgttacagcgataataccgctgggaacatcttgttgcaacagcttggcggccctaaaggttttgaaaagtcactgaaacagattggggatcatgtaacgaaagctaaacgattcgagacggatctaaactctgcgattcctggtgatattcgtgacaccagcaccgcaaaagcactagcaaccgatcttaaagctttcactttagataacacgctcacgactgacaaacgcacgatcttaaccgattggatgcgaggcaatgctactggtgacgaactgattcgggcaggcgctccaataggatgggaagtcggcgataaatctggagccggaagttacgggacacgaaacgacattgctatcgtttggccgcctaacagagctcctattgttttggcaattctgtcaaaccgctttacgaaagatactaattatgataatgctcttatcgctgaggctgcaaaagtcgtccttaacgatctcaaataatatgtttagccttttgccacaaaggaaaagacattacttttttaactcctaccgttcattttttgatgaacggttctttcataagacctctagaatcatatatttaaacaccacaaaattaaacgttattatatttaacggcaagttttcattttatggaacaagtaaagtttgaatctgacaagaattaaggctaagcaccctaaaatccgttttctttccttccaagaatatactccttagtgcaagccattataaagaagtgaacatacaatgcagacaactcccttaagtctcttattctgtgaccaatttgtaatactcatgaatatccggactcacttccaatatttcgtctcgaagacactaacatatcaaaccacttgaattaacataactgaacttgatattggtcactggcagtttcaatgcaatagaacaacatttgttgactcagaggttatctatatgagaattcaacaatttttttataataattcatatttttgtatcgttgcacttggtggatttgactcttttaatgtatggaaccacacttttattttttcacctcttttgagatcatctgtgttatcaatctcacttaatcctacaattactatgttatttttaaacttgttcataagttgtccttcagaaagatcgtaatcttcttttactggagcttttgtatcggtaatgagaattgccctttcattgtctttaagcacgacatagcctactaggctctgcatctttgtttcttctccgtgttgttcatttttgcagcctgcaaggaaaataatgagcactatcaagcttactccgattttaggcaactttctccctcccgtaatgttaaacaatctcactccataactacatatcaataaactgtagtgtaaatctatccagaaacttcttcattttctcatattgaatcttttacaagctgttaatacacagactaaatcgggtaaaaattcgtagaggtgatttctttgaatgatgatcattaagtaactcattactcttcatttattttttcaacaatcatggtattggcggtcgccatctttccacaatacacttcttggtttgtaacagttttcttcttgagttttgcacttatctatacattccaaatacatcaaacaagttcttcaaaagcaatatcttatatttcgtattttttattcattgtttcattgacttacactttagttaatatgtaatagtaatcctccctttgtgggaggattatttgtttaagcttatttctaggctgcttttgggccacctctatctataatgataaaactatctgaaccatttttttcttccgatctttgtcttcgtaaatagcaacattttggcgtgtcattaatgtaataccggccattttaaactctttttgatctttaaaataaacaacagggacattcaccaaacggatctacttctttttgttctttctcaaatgtttgtatgtggttgtcttcgaaccatacccttactcttattccgctaaaatcgagatttttactttttatgatccattattctctttcaaaataacttccaactacaacataatatatgtataaattgtaaatggagttgatgtaattgaagattaggaaaatcttattgagttctgctttatcctttggcatgctcatatccacggttcccgcattggctgctggcacttcgtctgaggttgcagtaaaaagtggtgaatatgattatgacactatataccgcattagtcctcttccaatggacttccagccaacaatagaatacaacggttatacttatacgcttacacgacattattttgattactcaatcgggttttacacggctatttatacaaaagttgtttaaatttataaaggagctttttagctcctttttctcttgttttaagcacaaatacaagtttaaatgctggtaataaaaaattcactttaaagaagcgccgcccgcaaaatgcggcttttgcacactacgccaattttatatagaaaagccagacctcctccaagaggttccagcttttcttaatgtgctatcgatcttcgttagttcaacgggaacttaatcattcggtacaaatgcagcctcccacttctagttagggctgatggcggaatatctgatggctctctacacatcagacattataagatttcaatgtagccttctgtaccatgaacgcgaattcgttgcccatcttttatcagcttggcagcattttcaacgccaacaactgcaggtaagccatattcacgggctataacagctccatgggtcatcagtcccccaacttcggtgactaggccttttatggatacaaacaatggtgtccagcttggatcggtaaaggaggtaactaatatatctccatcttctaaatcagcatcttccatgtttaaaatgacacgcgctcgcccctctatcactccggaggaaacaggtagacctacaatcgctccggctgggagattttctcgtttatactcacctgtaacgatttcaccatcagacgtgataacacgtggtggagatagtttttcatataatgtgtactcggcttttcgtgcgctgatgatttgataatccagtttatgtgtgcgtacgacttcgtgaagttcttcaaaagtgagatagtatatatcttctttttcatgaataacgcccgcttctatgagttgttcggcttctttcagtaaagcctgcttataaacgaagtaccgattaaccatgccgtattttggatattccctaaacccgctgaaattccggatgatatctatcattcgttttgtttctttggctttttgttcaccatccggtaattgcttcaatcgatctaataactcttgttctttcttcaaagcttcctgtcgcccttgctcaaatttccgatggctggcattaggctcactgttattgatattattaagaatcattgggataagtgtagttggtttttcgctccatcgagttcttgtaatatcaatttctccggtacatcgcattccgtatttgctgagataatcatagatcgcgtctcgggttttgcttccgccatcaaacttagccagttcatccaaaaaattatcatcttttacatgttgtaagtaatcaattacctctggataaggacgaatcacatctgcgacgtctaatagcgcaagacccatttctgaagtaatattatggggtacagattgagaaagcgtatctgctgcgtttttttcacctaaccactcgttcattttttcgttaatccataatgaagcattcatagcagttcgaatcacaacagaactttctgagttaaataaaatcttctttaattcctggatatcttccagaataaaacgaaataaatctgatcctgatttcgtttggatgttttgttttaactcttctatcgatgtttgactgctctcaatcaaatcagacacgattgtcggatcgttttcaacttgagccggcatatctgcattgcctctgctgggatttggtgctgttttatcatttggtatcgactttatgaaatctcgtcgccttattatggtcataagtgcgtcttttaagagctgatcgtgctgccccatgccttttaagaaaacttctctgctgtcaggggatgccagatgatgtgtgacatcaacaaatagccttccaccggctttacgcatgggtgcagcagtcgtcaacagaaaaaaagacaatcctagtggttttatgggatccgtcatcatttgttgatgaccaacagaaatatagacgtgattttcttggtcactcgcttcagggatggggaataaagtagtgattggacgactctgtacaatataaaaagtatcgcgggccaaacaccattcgatatcttgcggctggccgaaatgagcttcgatctgtcttccaatgcgttccagctgtaaaatttgttcatcagtcagtgtttgagccttttgctgatcagaatcgatctgatgtgtttctgttccgccttcttttcgtccgtagatagccaattttttagttgctattctcttatcgatgatttgcccatcctgtactttataacaatcggcagataccaatccggaaaccagtgcttcaccaagtccaaaaccggcatctatggataacacctttcggttggaggtaatcggatcagcggtaaataaaatccctgaagcctgaggaaaaaccatcctttgaacgataacggataaataaacttggctgtggccaaatccattttgcatacggtaaataaccgcgcgatccgtaaatagggacgcccagcatttactgatatgctgcaagattgcatcgacgccgataatatttaaataggtgtcttgttgaccggcaaaagaagcatgtggtaaatcttcagcagttgcactagaacgcacggcataggcatgttcctcgccgaactgggagagatagtgagccactgctttcacaacatcggaaggaatgtctacttccataatgatttgccgaatcttccggctgatgttaccaatctgatctcggtcctcaacttttagcatcgccaactgatccaacaacacttgtaacgtttcgttttgttcgatggcttttagatatcctactgttgtgacacaaaatccttctggtacttgtataccttgaatttttgataattcccctaaatgtaacccttttcctccaacgagcgaaaactgtgttttttcaatttcatgtaaaccgagaaccaaagaactcattctacatctccccttcaaaaaaatattgacaagagcttcctagcaggatataataaaattataagatggatatctataaccttttaaccagaaagcgcacgtagtgtgattatatcaccgtgtctgtttttgtgcaatataaaaagaacctgggcaatttcaccaggttctttcttaatttacataactagtcacattaaaaaacttggttcgatctgatacaatcctctaagggtatcctaaagttgggttcttttcgaactagtctgtcttgttccgtagagtccccatttatgaattagactttttgttcttaacagtcccaccgttaactagtataaagttatgaggatctggttaactactgagatatttttattttgagtaaggcttatgtttgataaagaagggttatgtaaaggtgtctgttgtgagcaagcgctgactacaaaaaattgatagcattctcatttaaataccattctattaacctatagaaaaagttataaaaccagatggagaatatcctacctccagtaattccaaggccgttcacctagtagaaaacaacctttaaccattactaacgattttaataatcattgattataaaacttctcaaggaacgatcatcagcccgttagctacccctgattaaagatgatctgctaccacactgttacgttagaacttccactactttgatatccttctgtcgccatgacttggtaagcccaattactgcccagattcattccatggctcttccatgcgttcacatgattgctgaaagtgattgtagcgttgcttccggttggtctcttcgtctgacgaacactccagtactgcgtaaaagtagtgcgatcgccatcaatggaaggtgcgttataacgtgtagttgtatatatgtcatatgtacccccatcactttttacagtacctttatacgttccggtaggcctataagtaccccatgaatccaccacataatattctatgaggggcgatctcgtccaaccatataaagttaaatatccattgccattcggtgcccaaactccggcattatagtttatcgtcctaaatggcgaacctgtagtccaacctttaccaacaacaaaatttccggtattagaccaattaacactgtaattcccgccagacccattgacagcgtttactataccgcccccatcagtccaattttgccagtagtctgtgctagctgcagaggcggttgccgaaaacaagctaatactcattaaagctgccgataatccaactaagaaattctttttaaacttaaacatatgttacctcctataatattttttccgactttgaggtagcactcgtatacatttaaaacattcttaattactaacgccaatgcttttgatcgtccccttcagtataataacacgaattcacgagtgaatattaaaagtatttgtaatttaattacaaatacctagaaacacattataagtggtcttcttccaccatatcctgatccttttttcgtaggatcacaattcttgtttctaattcagatggagtaatatctgcaatgaattcccattgaaccatttcaaataaaggagatacacattagagattgtgaaattattgtagctgccgcttgtctaatgaagggaagcaaatttatgaagaatatgaagaactgaagaagaaaacaattaaggttatactaagaaagaactgctcaattagaattattgaccaaaaatttgaggatgatagcttagatcagttttacaaagaagttgcaagatttttatttgaaaggactctgaaaaagaaaaaaagaattgacaatcagggtaactgtgggatgtaaccgagcctccaattcaaaataaaaatctttaaaattcttattttatttaaagagggactgtatatccctctttaaaattaagctttagattgctgctgaaagtaataaaaattgtacttttgatcaaacccttcttcgctaccacaaagaaaaataatgaattcaataaatgcgataatagaggggataccagtccagcaaaacaaaatatatagaataccttgtcctactcttcccaaataaaacttatgtattcccagacccccgaagaaaaatgctaataatgccgctacaattttgttcttcttgcttaccatgacttcctcctagctcattgctgccatttttaaaataatgctttcacattataatgcattttccaccagaaatcgcgaaaatttagaaattcttttgagatttttttatttaattgagaaatgaaagctcatataattgaactagatggttttgggaggtgtttattcaaaatgtatggcaaaagattacgtcaattacgaaaggcacacaaattaacaatggaacagttaggcgagaaaattggaattgcaaaatcaagttacggcgggtatgaagctgaaagcaaaaaaccaccattggacaagttgattattttagctaaactatacgatgtttcagttgattacatacttgggttaacagatgatcctgatcctaaaatggaaagaaaaaacctaaaagagtttttagaaaaaccagatattcactgggatggatataaacttacccctgagatgttagatcctatacggaaaattttgaagttggttactgcaaacaacaattaaaaagagcccttatgtgggcatttgcataaaacaattattttatctaaatctaaaaatttggattccaagcaaattcaatgttaccttctgttcttacgactaaatctttgcttaatctctctttgttaaccttatattctttgcagcttaaatattgagcttgtgcaatgaagttatcattacttgacattatgtatcttttgcgatcacttttccttccatactctttaaaaatatccataaatataacatctgctggcatcttaccatactttttatcatgcgttatctctggaaagttttctaaatgtctaaccttgtctatgattcgtacaatttccttcttcacatgacttctacgctttgaattcttcatgtagatctcaattttaaaacgttttaaattgtttgtacttgtgtctctgatatttttaacgatatactcttcttccttaatatcgtgataatgacaatgcaaagtataaattccgctaactgtatcatcatcttgaaaattcgcaccaaaaagactattcctacttattttatcaactaagtattgggcatctataccgttttgaatatatgcaataatatcagctgtatcagttaataagaaagaattaatttgtttgtcgttattaaatgtaaggaaaagcctatcggactcaggatacaacataactaatttaacaaaggtaaatataccaaactgaatcaattcattattagaaggaacttcatatgtagaaaaatagaggttgacttggttgtttatttcatccacattcaaaagattacatcttaaattataagttgacatctcgagttttatccaggattgataaacaatatcggttgtattcgaacaaattgactgagcaatgctcttataattctttacattaaattttacaataccggctagcaatccgttaaccagatcaattattttatatatctgtctcttaaattgagaaacacttacttccttacttttaggttttcctctgttagtgaagttaaagataattttatctttctcttttagataagttcccccatggttaatagcatttctaatatctacatcaatttcctttgttaaaattgtacacccttttgaattaagcaaattgactaaagggcctagattattttgacttaacaagtctttatcatctatggtgttaagcaaattcctcaaaaatttatatagattgctaactactccttcaactaacgaattatataaaggcaaatacttgacttgaatttcagtgtctctcggaattatagttttattaaataaattcaatgtactcagtacacgatcatatgatgaaagggctaaaaaaagttgtctagactgtctctgaagttctcaaaaaacaaatcagtgttaacgttcttgcattttacttcatcaattaagttgtaaataaaatctttaatatctttattccaaaactgtttctcctcatcaaatattaaatcataaattaacggaagccatgtcttaggtatatattgtatcccctcaatattttggtctattctctctttgtacaccttcataactaattcactatcaaaccccatgaaatctaatgatccaaatgcagcttcaacgtaatcactgttcaattattccctctcctagctcctcatttaataaaaggattcttttatcttaatagatgttaaatttacactctccccatctatttttaactgtctcactttctaattttaatttgaatatagctttaatagttcttccactggataactatctgttttatttatctctataaaatattctaactgccaattttgggttttaatagcttgtttgctagtgggattctcccatctagggtaaactcgaattgccatttttccttttgtgtcggatgttttaaggatattttgttttacaagaacttcttttggaaagacaaattgtccgaaattattatttctagtaaaagtgttgataaccaataaatcagttgccttttcatatgaaaaggcttggtttttaccatctccatctttttcccaaaaagaaacaaactgtcctatcttgttaggtgttatttttgcaactctaaatcttaccgattttgaatttaattgaaacatacccgccccatagtctgaattttgagcttcttcctggatagcatttagggttaagcgattaggtttatataaaactttatttacatatgttaacgccttataaaattcattcaatgctttgtttgtactccttatttatcgttgtattgcaacctttttcttatccatcttactcgacccctttcaaaataaagtaaagccaagcaattctgaattatttttatttctttttttgactcttaatttaatccattcttcatcatcagaatatggtttcttggttgttctataccatccgttaaaatgagcaactaactgaatcattattttctcagcttgacctttagagtccatccctaattgtgtaaaaccatttttactacttagcggatctcggtctcctggcttatcaaactgtttaagagctatgtagtatctcctgagtctgtaccaaagagttatagagccaccaaagtgatcccgatagtgattaacattaagttttggtttatagccctttgactttaaatattcggcaatttcttcagcgccaaattcttgacctatttgacctctttctttaagcacattctaaaccccactctgaataaaatgattatttcattactattatactacaattttccatggtcacactaaacaaaaagcagtctattcagatctgctttttattgttttcttcttttaactttttgtttattttgaacccaattaagatattgaaaatagctgctggaagatataaaactcctgcacctattattcctaatgcagtacttgagctcactataaatgtctgcatttctgtgtttcttgacttcaagcaaagtaatactaggaggccagctaaaccccccataagccgtgcaatacctggaataaagaaatctgttaggactccaaataattgccctataattgatagcataatccctaaaaaactggacaataaaactaaatttttaatgtcatttcaccccttttcaaagtatatcatcgggctcgtcatggtcaatcccatatttgcctttgattttctcgttcccacaaccaggattcttttcgactcataacgagctctcactagctgcgctcaatgtttttggtaataataggattttacccaatgataatttcttcccttattttcacaccattcaataaatccctttgattgtttttctgtaaacaacacccagtcatttaacagatcttgataatagttaagtgcttcgttattgttatttcttgtttgttgacattctaccttgttgtttaactgtattgacttaataataagtgctgtatcttctttaatatcgccaaggtacaaatcttcggatatatgatgaaatgaataccaaagtgcgttcaaatttatatcgattagcgttaataaggataattgttcattgctgccaccaagtctaagcgcattgtgtaagtaatcgacacgtttttcagtatttaaaaacacgccataccacctatatggccttggatcttccggattactcttcatccatccctcaagtaaaggctttaaaagttcctcttccaaaggatgaacgagtacatggtgaatatcatctgatgtttcaaataaatcaaatagccaacatgcaaacttctgttgggcattattatcccatatctttgcttcatcaataaaagaagataatgctttaaaggattccttacgtaaccctttttctttgagggagcagaacttttgaaataatggatattcatccaatctgtcacttttcaagatattagttaagatatttaccattgctcacatctctcttcgtttagaatcaagtccatgttatatttagcctttgtaccttgctatatcactaagaataacttgatttccattttcctttttctacacctggatgcatttcaaaatgattttaattgaacttgaaagtgatatgtacaataaactgagttgctatcttcaactataaagtatgtatcttggattaagaaatttgtaaagccaactgttttgagtatcgctttactcctcatgagcatatccatctggatatcattatcagttagaaggtccaaattaatagtaaacgctgtatgtaattcaaagaaagaattatcaaatttaaagtttaagattttcagacaccccccccaccttaccgtttcctttattatacagcgtgatcttatctaattaaaactgctgttttatacagaaaataatgtcctttgttcctttccctctcccgtccattgcagatgctagccacttcatagtttctttaatatagttttaataataaaagcttcatgaaaaaaggtgattttttgcccgcttgaacgccccctcaacatttttaaaaattccatgggcgtttcagtacattctcctttccaagtttttgtttcattgcctaaccattctcccgggtaacgtctttttcagatgacactttaatctctccattctgtgtgaaattgttgtttacttaattagatgccataacaaaaaaagcttcctaacttcagatgctggtacgctttctttcttaatatatgaacataaaacgactacgtgcattctcttgtaaattcaacctttctatatttagaaattttaatattcgaaatttatcctttccctctttacttatatatggaaaaaagtattatttacctaaatgaaaaatagttaaaaacgtagcagaaagaggttattaaatgaaaaagttatttgttacttttcttgtgctaatctccttaaaaagattgcactagtaagtattctctagctaccttgtcaaatgatgactgcaaaacaagctggggactatgtattgtgttcccaagtaaagaagttaaactttattctccaaagagtcctataaaggtagctgtattagatagtgggattaatagctctctgtctatttttgaaaatagttcaataacctcatatgatgctataaaaaacaattccactacaaaagattctttaggccatgatacagccatagcgggtgttattatggctcctttaaataaacaaacagtgcaaggaatatctcctcaagtgaaattattcgatgttaaggttcttaatgataaaggaggtggtgaagtccactctatgaaacaagtaaagtctgaatctgaagaatatgtattttttgagcctattttatgtaaggttaagcataaatttaagactaagcacggtaaactccgcataccttccttcgaatcctggagagtgtaatctctccgttacataactccttagagcctagcttttaaaatccgagtaaaaatttagtacatggatcaattagttgctatcgaataagaactttagtgaattaattgctcatgtcttttataaatttgaattgtccttttttatctaattctaaaaacaaatcaatccgattttgtgaactacttcttcctctaacttcactcattcttcactcatttttgcttgaaacatttcttctgcagatacttcatgagctttagcgatccaataaatatcttttaacagtttttgtgcattattatatgaccagattgtgtatggaaaccgagtttgaattacagcagtttcatcatctggagttgctaccgtatatggtaatgacctgtcaaagatctcagtgtcatagtcataccacaaccagagcatgtcagcagtattatgtatgtaatatcctaagtactctcgttgaaagttcatctgttcactcactgcttttaaatagaataactattttataatctcttcttaataccctccacttaaaatacagtataattgtaacttggatacactaatctatttacatataattacagtgtatttcattaaaaaatcaggagatgattttattgaaaattaaaaaggttattacaagttccctcttattaacgtctttatttatttccgctgctaccgcttatgctacacctgctacctctgttaaaagtcaagatgctatccgaatccaaggagatcaaatggaaatgactgtcgtgagatactacacccaagaagaatcccgtagtatcccttatacgattcaatatgcagagaatggttggtacggaaccttgactgcaactaattggaaacagcaatctgatcttagagttagagttgaatatacagggactgtttacttaggacaataataaatgaggggcgactagtcccttatcttatttttagttaaaaactatcttttattcaatctctatattcaacccagttgatctaactttgatttccctcatctctccaatctgtggcatatataaatgtttcttttcattagaaacaatttcacccttccaacaaccgttttgcacaaaggattttgtcccgattggtaaagtttgaagatctgcgttctctatgtattctccctcctctctataaatatctccttgttcagaaatcctccttttcgaaactttaatgtcgattttgtaaagtgaattttcatcctcaatcattaatttatatagccaatcagttatttttgattgctcttcactaccgttaaccatatcgaaaatcttcctgtacatgtcattcctcttcttttgaaaaatacttgtctcacctctttaatagttaaagtttcttgattttgcacttttccactcattaactatccacttcatatgtattcattaatttaatgataaaaccacgattttaatttaactttaatatgcaccatcttgagaaaatcccctttaattggtaaactcatacttaactttttatatacaagtgggtgttgccttgaataaaacaatcggaattgttggattaattatcagcatactagtgcaaactttttcggccgatgaatcgctatcgcataagattgctacggctttgttattggtatcaataatgatttataattttgaacatgctaaggattattctaaaaagtcacttgttattttaggagttacctttattcttttgatgctaggagtttatcaactgctctcatttaccagcgattactttgaaaagcttaatgtgaattttagatataccctcttatttgaaatagcattaattattgcattggtaacgattgcagtaaatgtaatgaagtacattgcgaatcggttaaggaaatcgactaatggtaaagagttatagctctttgccttttttatgctaaatgcttctttctatgcggtcttttatgtatgaaatcaaatgctaaatcaacttttctctggttccctttcctctgttactcgctgagtaacaacaataagttgaccgttttcttgacgatcaatactcttaactgaatatcctttagaaccgtaatattctccgataatctcatcaacgtggttactaagcagattcctctttatcacctgaaaaacctccacttattttatttttattctttattttttttatgatttcatcctataatccatctctccatttgccctctcctctatcacgacattaaccgacacacaatttccatatatatgggagtaatttcgctatttccccaacagataaatccatataatgtaattgtaagaaaaaattataagaatgggggatttacatgagttacaaaaaagtaataacaggtgttgcattatctgtaggtttacttgtttcagcatctccagcgttcgctgcaagtactagtcccgataaggaaatagtaaatgttgcaagtgatgattttaaagctcaagctatcaaatgggatctacctagtactactggtatttttgccaatacctttgaaaaagacggtatccgctggtatttaaaaggtattacaaaagtctcggaaggaaattggattggccactatgaaggtgtacgaatataagatcaaaatgggggggcatctagctccctttttaaattcatagtttgccagctctatctggttaaagtaatccttttaaacatagttcaaaagcacataccaattttgtatacatccccattaatacatctccctctctttaaaacagtctttttatcaagtgtagtgctactcataaacaacaaagacattatgatcatcaacaaacatttcgctgccatcagacaagtgtatccaaaaagcctcctctggttcatctctatagtcataaattgcgactacctttgtatttgattcttcactcactgactttctgacagttatttttatattatcttcaggcaaaataattgatttaatcattcacttcaatccaatcaaggtttgtattgcaccgttgtgcttcaagtaacatctagtcacaagattgaaccttattcgttaatacacttggtcccaacttttctgttctagcattagaaagacgcacttgaactttaacattcttcatttcggctgtaattgagtcaatccttccagcccaactaggactgtcttcaggtgtaggataaagtttaaatcgccaactaatctcacctggtttagaagcaaaaccttcgtaggtatcgtaatttccatatgaagatggttccggaagatgaacagcaagaatacttatattggttcttggagcactaggcggatttaattgcaccttataaattaatgccacgccttttacatttctaaggctctgatcaacaggttccattattacactacaaggcattgtacttgcttttacttgaattggataggcaacagcagcagccaataaggatataaccaaaataaatcgtctcatggagagttcctcatatttttttggttaatttcccttatttctggatcgattattcatatgtatttgatctggacttcaattttattttgatttaatttcaacagttaaactgtctggatagttttttaaatcaagtgcgtttacatgacagtgacctacattttcttctttatcaacgtaattatagaagaacttttccccattattgatgatgacttcgccatgatgtatgtactccatctctgatcccttgtaccaagttaccttaacctttgtgctaggtttgattttatttaaatcaaatactgttatttcttttagcaagttcatttttttaacctcctcttctcttttacttttaatctaattccctcatgtcctcctgctgctcaatataacttttaaagtcctcccattccctatcaatttctttaatattcctagcaatataggtttctgtaatgtctggatcaaccaacttttgaagagaaagttggtacataaattcaatctttgatactgtttctagaaatgactgggcataactttttgctctatttaagcgatattgactcattccatgttttgattcctttattattctcactcccttttaatcacattaaaatgcagcttttatttagacttcatcagcttgtctaatagtgtctaacaactctttcttcttgaaatatgtctttttccaaacgatccacttccttttgcaattcagtagcagcagcattcttcagaatccattctcctactccacagacttccttttgttctttctcaaacgtttttatatgttgatcttcgaacctaacccttactcttgttccgttttcaaattcattattaaaagcagctgctttcttttattcttcaagctgcttaatccttttgttgttgttaaatgagttacttacaatatttcctgattcacgagtagtacttataattaataatggaaagcttatatcacctttaggtcttaaaggtacgttgaggttttgactcggttagtaacttttggagaggagttgctgaccatctttttcattaaattaattgcatacagaaatttaataatggaggaatttagattgctgcttaatgacagagattgctgcttaatgacagagaacgttttttgcttgagtatcttcttgtttctaatcggatcaaatcgtcgtttgataccttctaatatactcactatctctgtcttttcttcttcaagaaaagctccaagaaaagatccttttgaaaattctggtttaaaggatctaggactatctatgagctcaccatttgatacaaatatactcagtcttatgtccttcgatgtcttacggaagaactgtttgataaggctagagctctacatagaaatatcggtgagcgtgtttactttttaaagtctgacgtctgcattttgtatcatgagtggatatcgtgacatccatttgctgcgacttcttttcaaatgaaatgaccaccgcaaaagaacagattagcaagcggttgtactataataaacacctaatggatacttattttaaaggaaagattgaagagcataatgtcattacggattgcgacattgataaggtgttacataagatgtacttaagatttggattcagagagtataaacgaaacaattatgagcatgtctttgatcttttgggtatataataagtcttatactgctttttagtaacaaatattggatttcgagtttttttcggctgactcacaaattcgaatgaaaatcaagggcaaaattaaaaaaatgaataattaagagggtgtataaggcttaatattattaatcgttaccgtaacagcaaaaaatgaatcgaagacttatttttatgcaaattggcgaatatcaataacgtcttagtcataatacttaataacctaaagcaaaggctgaatttatgaaagggttattttagatgggtacatataatagaagaaactcgtcacagataaatcatttagatggacggtgaggaacttaaataagctgcagaaggaagatatgaagttgttcaatatctccttaaaacaaccactttcccctactcccgcttatgttttacgatcgtttaccccctattcactaattaaagtatcaaaaatccttatgtttactgtcttttttagctcattataaatttttacgataagcatgttattcgtgtacgatatacgacttgactgtaattggtgacgatttaacagagatatttaatgcacttctaacttttttaactgcaatgggaatcattgttgacccaacaactcaaggtatttctgatagtgaacaagcaatggattatgataaaccccctccccttctcttaattgaggagggtatttttttcgtaatgaaaaaattgcagaaaactttacatccttttacaattttttcaatgactatgttatgattgttttcgagagatttttgaaattttcagaaagaggggtttggatgagtaagatcgcttcagaagttgtcgctactacactgaatgactggtacattgctataaaaaagcaaaaggttgatgagtcaataaaatattattcagagataaagaaactttttgatgaaatggaagaagatcaagaagttcttgcgtattatagtttattagaagaaagacataaaatgttgctacattcctcacgaggagaacctttgcaaaagcacacctattttactgaagacaatcaaaacttcattaaaaaaacaaatgataaattagaatacaacttttatctatttgaagcaatgtatgaggcatacaacaaaaactatgatcgagcaattaacttatatggattagctgagaaaaagcttgcagaaattccagacgaaattgaagcagctgaattttactctaaagtctcttacttatacactcttgttaaacaaagcattgtggcacaacattatataaaaaatgcaatttcgatatataagcgacaccctgattacaaatgcaaacttgctacatcaacaatgattgcagctgcgaactatgctgatatgaaacgatttgaggaagcagaaaaatattacttagaagcaattgatattgcaaaagaaacaaaagatgaatttttgaaagctcaattatttcacaatcttagcatcgtttattctgattggaataaacctgataaatgcatcgaatctcttgaaaaagcaataggaaatgaatcttggttacattcaatttattatataaattctttattcatgataattaaagaactctttaaaattgacgaaaaaatgaaagccattaatttttacaataaagcacaggaaagactcatattaatggagaataaagtatacgaagccaaaattagcatcttatacaacctttattgtggtgaattaaaaaataatttcaataattgtattagtaatattgagtttttaaagcaacaaaatgaacttgaaagtgtagatgaattgtcctacatagctgcaaaaaggtttgaatcaataggtgcttttgaagaagcaacgagctttttcaatgcgaaaatttgggctgaacagaaaatgaatcaggtggagggaatcttatgaaaaaacttgtgctttgcgtatctattttagctgtgattttaagtggagtagctttaacgcaattgagtacagattcaccatctaacatccaggtagctgaaaggcctgtcggaggttaaaaaaggttgattaattaatttagccctactcatacacttgagtgggcttttattttatgatttatgtccaccagtcaacccagctctgtgaagcgctgtacctgcaaacgtaactgagatatttctcactgttttgcccgagtaaaacttattaaagaacatcaagcaacacttataaatatccatcgtgatatttgtgggaaaatcaattgttttggatcgatgaaatccaccaccaagctcatctttactgtaaccaattccaaggctgatcgttcgaccaactttattatgtgtacatgcccttcttgcgacttcctcacaaatttccaaaagaacagccttaatctcttctctccttgtataatccctcagtaaaatctgactcttatcaaaactaatctgaccttgcatcaactgagcacctatttctgataaatcaattccatgcgcatgatagtacaactggtttcccattattccgaacttcttttcaagcagctctaaaggaaatttagctaactggcctacagttgatatacccatccgattcaggtttctttccatcctccctcctattccccatattttagacagtgaaccttccagagtttatttggcacatcttcatatctccaacgtgcaataccactctttgttttcttactctccaggtcaagcgcaagcttactaagcaacatattgtcaccaattccaactgtgcacatcaaaccaaattctctccacatgctgctttggattgctttggccatttcttcaggattctcttttcctgcatctaaaaaagattaatcaattgaatacgtgtggacacatttttcaggaacaaatctgtaaaacagctttgtaatctcagttgaaactctgatgaaaagcttcatttgtggatttacaatgtatattcttggatcttcaggtatctcaaatagtctcgatcctgttttgattccaaaatcttttttaagtgcaggagatgcggctaatactacacttacctgtctctcgatatttcttacaacagccgatacagaagtataaaacacaaagtatattcttacgtagaaattgtgagtaatcaatcattgtatgtaactccttgttatatatactgtgttgttatgttgatctttaacgtgaagcttgtgttgttcaaaattaatgtaatgaactcttccggcggcattttcaaacaaatccatagttgtaaagtttgaatttcaaaatttaagtgcttcagaaacgagaacgtccatcatctcaatttttgatccatcaatcaaatcttgtttaagctgtattaaatgttctagcatcattgatgtccattgattgttcctcgatccctaaacatatcgactcactccttgattgatctaatatcaacagaactaatgttccttattcaatgcagataagaacaaacgttcgatgtaaatgttggtaataaaatataaaggtcaataatgatatccgtagtattaataaaggagagattcttttcgacgagggagagtgtgatggtgaatgaagaagaggttaattggatttttggtcttagttcctgctttgattatgtcgggtataactttaatcgaatcaaacaaaaagacccctgtagaagttttagaaagtgcttgggatgaatttgggttatttagttttgaaattggaataacagatccggcaattacaataggcatggatcaaaccaaaagtgaagcaaaacttcgtgaatatttaaaagataatctgtctagagaagccaaggaaaaatataagatttatatattcaaggacgatattgttaagcttgagaaagagcatcaagaatatttgcaagaaaataatctcaataagtaaaacgcccagcacttattgagctgggcactgtttcatatttaaattgaatttttataagcattaatagcttcgtttcgcaacaacatattatttttgttaaccatgcctatgttgtaagcttttttgataatatctaatacctgtgaatctaatgcagagagattacctcccggattaaatcttgatttccaataatctaaagacttatttaggtcaagtgagctttttttgttctcgggtttaactacttcatttttctcaagtttttcacagaattcactaaaactaattgatgaaagagtaggattatcccctccatacccttctgtagccaaactgcaaaatgctaagaatttcggatcataaataagatcgcttgagtttacattcatcacagataatcacaatcctctcagagctttttataattgtattaccttttccatttttacacatgttaaatatcgacaatccctcaaatcatttaataaggttatgtcaaattttaatgttgataaatacgcaaaaataaaaggaaaccatagttccaagtaccttttaggctttctaaaccaatttttacagcgtttagtccctttttgacaacagttgtgtttgaacctttttctgtcgtgcttttataagcatttgaaagtttactaaaagttgactctaaagatttaatggacaaatcttgaatttcttggctaacaatcttcatttacaattctcacttttcgttttaaaaacaacacctactcaatagttgaatttaggactacgccttgaattttgcgattcgcaaactatcatatcagctacagctttaaatgtttttcttagcttcaccatttgtgaccttagtcccttgtactctttggctcttttatccgcttcagagagcaatgaatcagcttcaaataccttcatttcattctcctttcaagcctactctatgtaaatttcaccacaattatttgcttgaataacagaaaaagacagccagaactgactgtcttatacatcgtgcgatcgtgttctataataattttctgcggtatagtagcaccattcccaaaaagttgccccattggattctatataccgatctagaaatatctcaaaatttaaatttaatggtgtatattcccctatttctaatataaaaagatagttgggatcccctttatccaatttatctttgtcgatcatcaaatggcacccttctaataagtgaccaattgggataccattgatgccttcaaacaaatcctcatattttaattcttcttcaatctcttcaaggctaaataaataaagtcctccacctatattctccccatcagaaagaatttcaaaaattttcgcaccgttatgtagtgtcatgaacttctgataatcctctggaagggtaatctgatgtttagcttcaaaactttgaatgtcgttaagggttgctttgtcctgtgaaaatgtaacaaggaactccatgatatctccttcagaacaaaacaattgaatggctcctttttcgtctaaaagacttttcaagccatttacagtcttatgaacaaagttagtcacatacatcacccctttatttccttttaacaataacctttcaaattccaaaagatgtgaacagatcgtgataggtgctcttttcagtgaatataatgcaataaattctaaaaagaggtgcctctaaaaattgaattctctaatgaatgatgacatggtaaagatcattagaaatggccttagcgcatcccagcatccaaagcatattcttgttgtaggagctggattgtccgggcttgtatcagcatcattgctgaaaaatgccggtcacagagtaacgattctcgaagcgagcggcagagcgggcggccgtgtctgcactttgagagctccctttagtgatgatttgtattttaacgctggcccgatgcgcataccgaataaccattcgttaaccttagaatatatcaaaaaattcaaattgccaacaaatgtatttctcaacagaaccccgatggacatcatttatgcaaatggaatcaaaacacgtctccaagtttttgaacgagctcctggaatattgagatacccagttgcaccaaatgaacaagggaaaacatctgaagagctgatgctttctttactgcagcctattctaaattttatcaatcaaaatccagcgagaaattggcggattgtcgaagaacaatacaaaaatcattcgttaagctcttttttaaacacgtatttttcatatggcgcgatcgatatgatcggtgtacttttggatatggaagcgtatatggggatgtcccttgttgaagtattgcgggaatctatctttttttcatcgcccgctcacttctatgagataactggcggcatggatctgctgcctcacgcgttgcttcctcaattaaaaacaaacattctataccatcaaaaaatgatgaaaatttctcaggggaaaaatcgtgttacgatccattgtcagcatcaacaaacggcagaattcacatcattcacagctgatctcgctattgtaaccattcctttttcaacattgcgatttgtaaaagtcgaaccataccattcattctcttactataaacgaagggcaatccgtgagctaaactatatcagtgcaacaaaaatcggcatagagtttaaaagccgattttgggaaaaagccgggcagcgcggcggcaaatctattactgatctaccgattcgtttttcgtattatccaagcagaaatattggagcaaatggacatgccgtcattctggcaagttatacttgggctgatgaggcactgatatgggacagtctttcagaaggagagcgaatccagtatactttactgaatttatctgaaatctatggtgatattgtgtggtctgaatttgtgtctggcacttcttttagctggagccagtacccgtattctgcggggggatttacagctttcgaaccaggacaagaattagagctgtatccctatattcctgtccctgagggcagagttcatttcgccggagaacacgcctcactcactcatgcgtggatgcaaggcgcgattgaatctggaatacgtgttgcttatgaggtcaatcgcttaccttagatcatgctcacatcttgttaaaactggttgatataaaaagaagtgaagaatttatactcctttgtttaaaagattaattcaaatatgggatgtctcaacattcagttctttattatttttatacacgttttgaatgcggacctcccttttcttccataatcattaataaatacccaaccatagaaaacgttttaattaaccatcgggcgaactttctttcactgtataacgattcttaatgttgcttttttatcctttacttgtcctctctttttttcattgacttacatttcttgaaaaccagtataaatcctaaaggaattttgtaacaaatacagaattggaaagataagcgccaaaagaaatgctaactccttatctcaaagacaaaactgcgcttatattaaaagaaagaggtgtctttagaatggttcattttaaaaactgccctgatccttctctaaacgccaattctcagtctcaccccgaattttcatccgaattagaacatattaagacaagaatgcaaaactttattaagcactcggttacagcccaaaatatcgaagttactgacgcaagggtgacggccgaaggagaggtcacctctcttttaaaagaacgtctcgacaaggaatattataggcttttatctaaaatcacccgggaagtaaatgtggctgacttcggcgctgttccagatggaagagacaatactgaagcttttcgaaaagcaatcgggaatggccgagtcaaagtacatgttccagcgggagaatacctcgttcaagggattaaacttccatcttggacaacaattgttggacaaggtaaagggatcacagtgattaaattgcatgaagacactccagcgcatgaatgggtgattacaaatgatgattatcaaaatggaaatcgcaatatttttgtccaaggaatgtcattagactggaatccaagtagacaatgcggtgtgagaaatccagggggacagttctccagttgtttaacttttgctaaggttgaatatgggtggatcaaagatgtggaagcgattaacgcaggtcttcatggtattgatattacatcgccaacgtatgaccatttgcctgataccgattggacaaaagacggatcaagatatatttggatcgataactgtgtgacatatggttcaggagacgacggcattaccacccattatagcgaatacatctttatttcaaactgccattcaggaaatccgcggggaacagaatttgctgaaggtgtttcaaactccaacggaatagaaattgacgacggctctaggcatgtgtggcttttgaataactttacaagcggcaacatccgcggagttgaagtaaaagcccatgaactgtggccagcctctcaaaacgtccatatcataggccatatttcttatcgcgatgttcgtgcatttgatcttcgtcatattggtcaccatcaaattacagatcctgaaagcacaacagcatacgatgtcacactcattgattgttcagcagttgaaccagttttcaactcgctttacgatgctgtgaccccaagagcgctggttatttcggcatataaaaacgttaatgtaagcggattcacagcgattggtgatccagactatgattataaagaaaaccctgtcgtagccttgcaatatcgcagccaaaatataaccattaatggtattaaaattcgcggttttaaaaaagccggtgttgatattaatttatcaggcggatcaaataaaactgattatattaaaatttcaaattttgatatttataaatctgctccaaaaggaatttcaatcggtggaggcctctacaatgtcaatattctaaatggaacgatgattactgacaatgggacagttgcaattcagtcccccaataatcaggccacaattctcggtgtacaatcagaaggttatagtgtggcagcctcaatcaaaggccaaacataccaacaagttccaatcaatttgaaaggaggcatacagcttgcaacgacctctggctttgccgttaaccaaacaagcgcagttatagcaggtaccggcgacattacggcccgcggagaaagaaatgcggtcattagctcttctggaggctccagtactgaaggctctcgcgcattaatcgcttcttcaaataacgcacatattagaggaaaccaagcgtcaagaacaatactgtcttctgaaaatattatacttgaggaaccatacaccgtggcaggaggtcatcaatcaataaagtggcttcttgactctgttcggggaaacgggacgtttgccggtgcaatcagttcttctttaggtggatatggagagtattttgagagttcaactggacagttaatccatactggtacaatcgtgactttaagaggtgaaaaaattgtgcccgcgaatgttggagattatatgcttggcgttatttcagaaacttcagctttcatttcaggagcctccagtttcgtctggcagggccgttatttgacaaatgagttcggcggatttatttatgaaacggtgactgatgaggaaagcggtgaactcatacgtgttcccaaacaaaatccagactacgatacagcgctggaggcaaattatcattcacgggcagcaagagacgaatggcacgttgtagggttggttggccaacattatgtgcgtattgacgaaactgtcaatcaaggagattatcttacggcacataatggaataggaacaaaagccactgaaggaagctggaaagtaatgaaaataacctctgcttacacatcagaaaaagggtatggtatcgctctaaccgtcatcaaatagtggatacgccgaccagttcaatatatgtttatccaaataattagatctcttttctaggttctttattccttgtatgttattatcaattttcaatatctaccaaaacacccctaatatactatcgtaattaacttatattataatcaaaaaaattttgacagctgttccttctcgttattcatgaaagttgctattgaaatgagtaaatggatatcatattagacttctatagcaaatacaccatatatatcctttaagtatttacaaattgaaaatgtttcatgaggcttattaaaagtattgttcttttatcatctgtaagtcgatacaaattgcattaagatcacacctaaatcacactgagttttttcttacaaaaaaatgaaaaccctttccattctaaattcatttcaccgttactaaaagtaatccttgcattccttcgcccttcatgctatattcatatagcgatgagctgaattgtgtaagtcgatgtacatgcctttacggcacacacgaatgtggcgtgtggtgcatcgcctcaatacgcaaagacgtttgccttaggcaaacgtcttttttgtgttatccgatttttgtgccgtttgaaacaggctgatccggctgcaaaaggacgacatcgccctggccgggtatgccgccgaggaccaagacttccgatttaaatccggcgatccggcggggcggaaagttcacgactgctatgacttgcttgttgacgagaccttccggctggtaacgcttcgtgatctgcgcgctcgattgttttatgccgatttctgtcccaaaatctattacaagcttgattgccggtactcttgcttcaggaaattcttccgcttttacaattgttcccgttctgatatccaatttctcaaagtcttcaataactgccatatcaataactcctttttctcctattgtaaaggagatatacaatattcttttaactaaagagccatcattttttatccgaatataaggtgtttcgatacaggcggggcggcattcctgtgcttttcgtgaaccatcttgtaaaagaagaaaggttttgaaagcccagcgcctcgctcacgacggtaaggttttcatttctctccatcagcattcgttttgcttcctcaaggcgaaggtcggcaatatagttctgcggggacttccctgtctgttttttgaaccagcttgaatagtaagctgggtgataatgctcgatttctgccagcttcttaatcgtcagccgctcaaataaatggctgtgaatgtatgcaattgaggcatagctatgggattgaagcttttcttttatgtattgtactagcatatgaagcgagttggctgttccggcctttgcttcctctgtcagcaagtacctgatcgaagaccagaaaggatcgagtgcagcttcaattcccgatcctgcacgatactcatcaattttcattgcgtgaagcggaacatccagtacaagacattcatttcttccgatagaacggaagcgatgctcgcactgcggcggaatatataaaaaatgatccggatttaatttcacctggcgcccctcagtctcaagatctatactcccttcaagcggaaaaagaaattggctgtacgcatgcttatgtgaatgataaaggcgtgtgtatgtccgtttttcgcaaatcatctcttgaagcgaatccatcagcaacccccttcctttggtcatcttttaatccggtaatggtgttccgatataggcgaaaatccgattttttcatataaagaaactgccgccagattttctttcatcacttgtaaaaacatgcgttccgctccgttgttttttgcccattcagtcaacatcctgatcacttgggttcctgccccttttcctctgtgctcctcagctacaacgatattactaagtccgccataaccatcaatgacagaaaccgtgccaagcgctgtcaggctttctttgtcatacatcttgaaaaaagttttacacggcggcatgcgttcgaatatgtgtttgtaacctttgtgacgttcgggtgaaaacccttctaattgaataaattcatctatccaaacagatgatggctcttgttcccacttgtatgtaaatcggctgttgtcatttgttcggctcataattgaccggcacaacgctgtcatctggaagcactcgtctaccttttcataacggctgtctgccaatgcgtcatcaagccctttcggtgatgcgttgctaatatgaaaacaaacaggtaagcctaaactttgataaaaaagttcggcctctagctgaaaatccccttcaggcatatccgcagacgtccatacgctatttgcccttttggttacgccaaaattcgctctgagaagccatttccctatgcttttttgaaaataagccggccatgaagctgccgctaatcgttcaatcttgcgaatgtcatccattgcataatgcctctcccctatgtatactcccttgatattatacaatattcagaaatataagacatccatttatttgtttacataatatttttattgtttattaataatcctgacaaaaatgtccgaattgaaaatgacaggctttctaaaatgtcctcctcacgttcaaatgcttcttttgcgattaaaacagtaaagccatgcagcagacttctgagcccccttgtcgcatgaatggcagtcttttcacttgcatagccgttttcaatgagcagcttcgtcacaagacagacaatttggtcagagacgatttccgtccgtttgtcgtgaaccttaagaagagccgcttcataatatccgggattttcaattgcaaaatcaacatatgcatgagctaaagaaagcatcgcggaatctccctttcgttcggttacggagtccgccatttgatcaaaaagctttgtcagtcctctgacagcaagttctgctctgatcgcttgcagcccgttgatatggttatacaatgacggggggcgaacattcatttttttagaaagtgcggcaagtgagacaccatttaccccttcctgatcggcaatctctgctgcagcgtctacaatcattttttgggtcaaacctattctcggtgacatgctcatcatcctttctttgctttttggatcgcctgtctcatccgctctgaaggtgatcgcaggaattttccatgtccgacagcgagacaggaaggcgccttatctgcgagcaattgtgcacttttgatggcctcctccttattccatgtggcgaaagcgggaaaaggaaacgtccattttatctggcctgatacagcgattcctccgtgcaactgaaacgcatctcctgctattaaagtgccgtttcttgtatcaagaaatgacatgctgcccggtgtatggcccggtgttggaatggcaagcagagaaccaattgtttcaccgcccgtcagcagttggtgaggctttgtttgtatgtgtttcggaatacctccttttataggcgtctgcggctcatcttgccgcaaggatgtgtcaccttggagcaagaatgaatcccgttccgagatcatgacctttgcatgcggaaatgtttgtgccaatgtatccagtgatccgacatggtccccatgtgcatgagtcagtaaaatatgctgaagcggttttccaagctgattcacagcttgaataatccctttatagctgcctggcagtgcggcatcaataagggtgacttcgttttcttcctctactaaatagcaattaaccggaaacaatgctggaaaaaaagtcagctgccaaaccgtttggtactgagtcattctcatctttttattcctcctaacaaaactaatggcgttagttttattattaactaacaccattagtttttcaagagtttattatttttttatcgctacataaatgttaacttgtgctcgctgtggcactgcggcactttgatcatacatctcaaaatcacctgtaaacgtgcgcagatgccgcttatcccaagtccaaatttccttccacgtttcaagcacaatctcttcaataggaccgattctggaagtgaaaacggcgtaagcggaagccggcaaatcaatgttttcatatggtcccggaagaatgtcgtcgtattcctgaaacgttccgactgaaaacgtataaaacccattcgtctcttgttcataattcgaatataaggcaataatgcttttgtctttttcagcctgtgataaaagagcgctcatatcctgcttccagaattggtcccacagtgccggaatcctcctttcttccgtcatttccagtgcgttgcttgtccgttgtgacagtccggcaaatcgtttccggtctaagtgtgttatatgtgaaaagcccatacgatctcctcctttttttaagattatagacaaagaaacctgacagcagtgtgtcaggtttcatatattttttgcatgtgatgaatggtttcttttactttatcccgtatatgaagaggctgcagaacctcaatatcctttccgaactggagcaaaaaaccgatcagccatggatcttctggaagtgaaatcactgcccggcagatttcatcttcctcacaacagtgaaggacatcatatccgaaccattcacctatgcgctgacgtgctgacggctgaacaagaataaccaattcagttaaacggtccttttggtaccaactcttatcccatggcaaagtgtccagctgaatgtcttttctgataaatgtctgatgtaagatagccagatctttcatccggttcagtttaaaaaagcgaaaatcatttcttaccaggcagtaggcatataaataccagtgccccgccttgcaaaccaatgtataaggttcagtttcccgaagtagtgtttccccgcttgcgcttgtatatgtaaaagatatcgttgacaaccgatcgatggcagcgctgattttctcgcgcagcgtcttttgatcctcagtatggccccaagccgtcatgtcaataaaccatttttctgtttggtgcttaaatgcttgagtagattgttcaggtataaggtgtttgattttttgataggctgtgctgtgagaaacgggttcatacatagatgaaacgctttgcaaagcagaagcaattgcaaacaattcctcctccttcagccactctctttcaagccgatacgtttccatgatgccaattccgcccccggaaccctgtgaggtcacaatcggaataccagccctattgatcgtctcaatatcacggtaaattgttctgacagatacttcaaacagctcagcaagctctgcagcctgcacttgttttttgctgatcaataacacaaccatcgctaacaaacgttccagtttcattctgcgcaccttttcttcttgtattttccaacaaaacaatcataacattttgataaagcttgggcatatctattatgcggcggaatacacctcgcatatgctatgaaaaaaggggtttccccttcttttttgtgttcagtatttatttcagctactatttccgaccggataagcatacacttctcaacggaggggatttcacatcatgcatcttacacttcagagcgtttatcctgccatgatcatcatcttttttctgtataaaaaaattaaaaggtccatcggataccagccgctgaagccccgctggctgttcacccgtatcattcttttctcgctgtttgcttttggactttcaatcttcagcgccattcacccttttttatatggatatctcattttgggcattcttggcggatggctccttgtctttttcgctaagaaaaacatctcttttgaaaaacgcagaggaaagatctattttcggactcatatttgggtagaaatgattctcctaaccttattcctgtcaagatttctatatcgagtgacagagctttatcttacctcgcctgatctaaacagccttggatcttacggtcagtcaatcggaacggaccctctgacaataggcgtcttttttctgatagccgtttattatatcggtttttcttcttttgtcatcaagctcagcagaaacgaactcgaacagcacggacacaataaagaaaaagacatccttgcccgctagcagcgagttaagcaaggatgtctttttcaatcatgctgcgtatgatggatcatttgctgaagaacatctaaaacatgttcatcctccggagagtaataaatcgatgttccttctctgcgcgatttgacaagccgaagatttttcaaaaatctaagctggtgggacacagtggattgcagtaaattcagcttttctgcaattccgtttactgcatgctcaccctgggacaataaatggagaattctgattcgggtaggatcagaaagcgctttgaatgtttgcgcgactagaaacagcgtctcctcgtccagatcagcagccgattgttccgtttctctaaattcagtcatatgtatcacctttctttattcatagttttatcttataacaaatgcgcttgagtgcaaaccagcctgcttgtattccatttcaatctcatagtttaaatttatgtttcaaatcaggtttttacttggtctgatataccgtcttatgtcataataaaaaaggtcatactgctccaaacattgagggtgaaacacagtgaagaaaaagagaaaaggctgtttcgctgctgcgggttttatgatgatttttgtctttgtcatcgcctcttttttattggtcctgctttttttcaaccgggatttaatcaaaaaacttccgatcgatacgaaaacgattgttttggaacgtttaaccgattacaaacccttggtggaagaagagcttgaaagccaaggactctctaattatacatcactcatattaggcatgatgtatcaggagtcaaaaggaaaaggcaatgatcccatgcagtcctctgaatctctggggttaaaacgcaatgagataacagaccctcaactcagtgttaaacaaggcatcaagcaatttaccctcatgtacaagaccggtaaggaaaaaggcgtggatttggataccattattcaaagctacaacatgggggcaggttacattgattttgtagctgaacatggaggaacgcatactgaggaattggcaaaacaatactccgagcagcaagtcaaaaaaaatcctgacctgtatacttgcgggggaaatgcgaaaaatttccgctatccgtattgctacggtgattatacgtatgcagaaaaagtaaaagaaaaaacaaaaactgttgaagaatctttgcaggttgcaacacttgaaaccatggaatccaaggctcatgaataagagtctatcaatttactgacaaaagcccaaaaatgaatttgggcttttgccatgtttacacgtaaaaaaagccatactgagtatggcttttaataatacggtgaaatcatcaaatatacaataacgcctgtaaggcttacatacagccatagaggcattgtccatctcgcaatttttttatggcgctccacctgcatgctgaagcctctgatcagcgtaaacagcgcaagcggcacaataattgcagaaaggcagatatgtgtaattaaaataaagaaataaatcgggcgcataataccttctccgccatagagcgtgttttccgcaatcgagtggtacgtcacatagcaaatcaaaaatagtaatgttgttgtgaacgcagccaaaataaagcgtttgtgagctttgatatttttctgtttaatcataatcagcgcggccaataagaagataaacgtaaagctattgaatatcgcattcagcattggcaaaatgtgaatattcgcatggctgaactgatctaatttaggcataaaaaacagcactgcgattaaaccgttaatcagaactgtcagcgtaaggacaatccccgtgtaatttttcggtttattttctgtttggttcatttggtgacctctcctaatttgtactggctatccaaatcgtatgcaaattcaaagaagatgtcaacggtttcgattgcttcgtcagaaattagacacacttcaaaggccggaggctattagccccggcctgttaggtttacgcctcttttatcaaatgttcaatgaccttatgttcattttcattcagcaggttcttttgaattttcgaatgaatgggtttattcatatgctgatccaagatatcggccgtttctttatccccggcaataaccattcgttcccatcttttcgcggcagctttttgatcaaggctggcagccagccgcttatacagtctcgattggttctctgttacatgttccctcatccggttctcttcaaatggtggcgctttgtctacagcggaatggctattcttccaagactcattgatcatatcatactcataacgctccaccgcctcaatttttcctaaaacggtttcaataattttcacttcatgctgctgagttaaaataaacgccgtacttgggtatgcctggcgcaaacccttcagctgatccaggacagctgtttcttcccagtaaaatcttgtatctacagggacttgaagcttaataggctcccatatgccgctgtcggaaacaaaaaacacgagactgcggggcatgtcttttcccattgcattcaagtattgattcattttagccctgattccatccagacacttttcctcctctggatcactagctgccaaatactcttttaatcggctgaatcctgactttagggcaatcttccattctcccccctgctgctctggatctctcatgtctgtattgagatacagagagagaattttatccggcggttccaattggacatactgtaatttgttaatcaatgaatcaatcgccattccgattcctcctttttcacaggttagttttctttttcctctcttaaaaacgatcaaacctgactttccgctaatttctagtaataatggaattgttgtttacaatacgcctctcttctaatacaattggtaactgtgtttctaagctgatttttgaaaggagtttgatcttgtttactattaaagaaaaaaatcgtcaagagcttgaagaagaattaaatgatttagaatttcaaatttatcgcatgcaggagaatatgaaggatttatctaaagatgccaaagtgcttggtattgatcaatcgaaacatgatgagtggatgattgtttcctcgattgatgatggccaaacatgcaaaattatgctaactgattgtaaaacggcttaccgaggaaaaggctgtttttcacttgtagcgtcttacaaggacgatgccattcatataggcgatataaaaggccctccgaatcacgggtttggttccatttgcatgaaatatttaaaagatatagcaagagaccacaatataccgaaagtcacaggagacatcgccaaacgggattggaatcatgtagaccggctgattcacttttatgaaaaacatcaattcaaagtatgtatcgatcatgatacccaatccggcagcattaagtgggttgatttgtaaaaaagtctggaagaaagagccaagatatgctgtaatggtaaaaaaccattgatggagggttctatgtacgcctcaaaactgaaaaagggagacgaaatccggatcgtgtctcccgcgaccagcatgtctatattatcaaatgaagcaaaaatccgagcacttaggttatcgggtaaccatcgctgaacacgcaaatgaatgtaatgaatttgattcatcctctatcgagtcaagagtccatgatctgcacgctgccttttttgatccaggcgtcaaagcgattttaacgacactcggagggtttaattcaaatcagctgctgcgttatcttgattacgagaaaatcaaacggcatccaaaaattctgtgcggctattccgatataaccgctctttgcaacgcaatttatcgaaaaacgggtcttgttacgtattcaggcccccacttctcaacatttgcaatgaaaaaagggcttgattatacacaagagtattttctttcttgctgcgcttcggacgacccgtttgaaattcttccttcaagtgagtggagcgatgaccgctggtttttggatcaagaaaacaggcgtttttatcctaataacggccctgttgtaatccaagaaggttatgcggaaggtactttaattggcggaaacttatgcacgcttaatttgctgcagggaacggagtattttcccgaaacagaacatactattttattgattgaagatgattatatgtcagacatccatatgtttgaccgcgatctgcaatcactcatccacctccccgctttttcacatgtaaaggcgattttgatcggcagatttcagaaagcatcaaacgtatcaatggatcttgtaaaagccatgatcgaaacaaaaaaagaattatccggcatcccgatcatcgcaaatataaatgccggacatacctcgccaattgccacgttccctataggaggaacatgcaggattgaagctatttcgggtacatcacgaatatggattgataaacattaatcagcttgtaaatttttttacaagcttttttagcgcaatcggttatgcatgccgcacgagacatgacaaatgtcatataggaggcatgatgtgtgctactacaaaagacttctctcattagcgtatactgaaccgagacacacaatgagaggatacttactatgactgaacaaaccattgcacataaacaaaaacagctgacaaagcaagtcgctgcatttgctcagcctgaaacaaaaaacagcctgattcagcttttaaacacgtttatcccattcttcggcctatggtttcttgcttatctcagcctcgatgtctcctatcttcttacgttagcattaacggtgattgccgcaggttttctgacaagaatttttatcatcttccatgactgctgccatcaatcttttttcaaacaaaaacgctataaccacattctcggttttctgacaggtgtcctgactttattcccgtatcttcaatggcagcacagccattcgattcatcatgcaactagcagcaatctggataaacgcggaacaggagacatctggatgttaacagtaaacgaatataaagctgcatccagacgaacaaagcttgcatacagactttatagaaacccgtttatcatgtttattctcggaccgatttatgtttttctgatcacgaaccgttttaacaaaaaaggcgcaagacgaaaagaacgtgtaaacacataccttacgaatctggcaattgtcgcgttggctgccgcttgctgtctgatctttggctggcaatcgtttttactggtgcaaggcccgatatttctgatttcaggttcaatcggtgtttggctgttttatgtgcagcatacctttgaagattcttattttgaagcggatgaaaactggagctacgttcaggctgctgttgaaggcagctcattttataaactcccgaaactgcttcaatggctaacaggcaatatcggttaccaccacgttcatcatttgagtccaaaggtgcctaactataagcttgaagttgctcatgaacatcacgaaccattaaaaaacgtaccgacaatcaccttaaaaacaagcctgcaatcactcgcgttccgtctatgggatgaagataacaaacagtttgtgtcatttcgggctataaaacatatacctgtaagccttccgcctgattcaccagaaaaacagaaactgcggaagaatgcctgatgataaaggaggtcttctaatatactagaaggcttcctttttattgttggagggtgcattctggctttcacaatgataaagttacaagtaagatgaaaagctgaaaatgaggtaagatcatgattaaaaatcattttacatttcaaaaactaaacgggattacgccctatatatggacgatatttttcatcctccccttctactttatatggaaatcatcatctacatttgttattattgtcggcatcattttgacgcttttatttttttcggtatatcgatttgcttttgtctcaaaaggctggaccatttatttgtggggatttttattaattggcatttcaaccgcctccattaccctgttcagttatatttattttgctttttttatcgcgtattttattggaaacattaaggaacgcgtcccttttcatattttatattatgtccatttaataagcgcagccgtcgcagccaatttcagtctcgtattaaaaaaggaattctttctgacacaaattccttttgtcgtcattaccctcatcagcgcaattttattgccctttagtataagaagccgcaaggagcgcgaacggcttgaagaaaagctcgaggatgcaaatgaacggattgcagaactggtaaaattagaagagcgtcagcgaattgcccgcgatctccatgatacgcttgggcaaaagctttctcttatcgggttaaaaagcgacttagcaagaaaattgatttacaaagatcccgaacaagcagctcgtgaactgaaaagtgttcagcaaacagcgcgaacttctttaaatgaagtaagaaaaatcgtttcctctatgaagggcatccggctcaaggatgaactgatcaacatcaaacaaattctcgaagcagctgacattatgtttatctatgaagaagagaaatggcctgaaaatatctcattgctgaatgaaaacattttgagcatgtgcttaaaggaagctgtcacaaatgtcgtcaaacacagccaggctaaaacttgccgagtagacattcagcagctctggaaggaagttgtgattacagtgtctgacgatggaacattcaaaggagaagaaaattccttttcaaaaggacatggcttactcgggatgagagaacggcttgagtttgcaaacggaagccttcacatcgataccgaaaacggaaccaagcttaccatggcaattcctaataattcaaaataaacataaaggatggcttatatgattagtatatttattgcagaagatcagcaaatgctgctgggcgctttaggatcacttttaaacctagaagacgatatggaagtcgtaggcaaaggtacaaccggccaagatgctgttgattttgtcaaaaaacgccagcctgatgtatgtattatggacattgaaatgcccggaaaaacagggcttgaagctgctgaggagctaaaagatacaggctgcaaaattatcatcttaaccaccttcgccagacccggttactttcagagagctattaaagctggcgttaaaggctatttgttaaaagacagtcctagtgaagagctggccaacgccatccgtagcgtcatgaatggaaaacgcatctatgcacctgagctgatggaggacttatacagcgaagctaaccctcttacagatagagaaaaagaagtgcttgaacttgtggctgacggtaaaaacacaaaagaaatcgctcaggaactcagcatcaaaagcgggacggtgcggaattatatctcaatgattctagaaaagcttgaagtgaaaaatcgaattgaagccattacccggtcaaaggaaaaaggctggtttaaataaaaaaggatcttggcatctgccaggatcctttttgttaacctgaaattccagtttgagaacctcgccgcaaccagaattaaattgatcgatatcctcgctcctatacccgctgaacgattgcttgattaacagcccaataaaagactggattgaatgatatccctgttaaaatggtcggccattgcacatcagcagaatttctgatattgattattttgtattttcagtatgacaaagttgtgccacttcgctcccgaagctgccatgcccaactgcaagagcttaatatcacaataaaaaaccgtctgaaatcaatccgattccgttccgtaaatggcatctgctacatccaactgcttattatctgccaaaaaagatacaacaccagctcgtttcgctgatcaaagatagtaacaaccagctataaatgtcatgatgccgaatgtctctgtaatgtggaaccaatcttttaacccgagagcccctgaatcgcacataaagagaaaaacgggaccactttcttttatcagcatatgatataaacagctctaagcagaacaaaaaaagacacaagccaaaagctcatgtcttttatcacaatctatattattagtttaagactttaacacttacagttttgacgccccaattagaagcatcacttttacttggtacaaatacgtcgattttatttcctttaatagcgccgccagtgtctgctgctgttgcttccccgtagccttcaacatagactttagaacctagcggaattacattaggatcaaccgcaataactttcgcattcgggttcttatttaagtcaatgcctgtagctgtaacgccggaaatgccgccgtcgttagcagtgtaagcagtagcagtaactgttagttcttttgaagcttcttgattatttgtatttgattgaacagccttctcctctgtgttaacagaagtttctgcctcagcctttgtttcttgtttaggttgctgttgtacagcttcttgtttaggttgctctttttgcacagcctcttgttttggtgcagcttgaggtgcgtttgtttgcgcattctcagtagctgtgtttgctgctgttgcctgaccttttactgaaagagttgatccagcatagatcatgtcagagcttaagttattccaaactttcaggttgttgactgtcgtgccgaatttttgagcaatcttagaaagcgtatctcccgctttaattgtatattgcccagtcgtggttgtttcttctgaagaaatggtcagtttttctcctgcaatgattttatcagaagttaacttgttccattcttttaagtcctttaggttcactccatttttctgagagattccccagagcgtatcacccttttgcaccgtaatttcttttgcagaagcgtgagctccgaatgcagttgttgaaagtgcagcaactgccacaaaggacataatcgtcttcttcataagtaaatcctcccttgttagctttttattggcggctaacaggtgatatcgtaacacacgtaaatgtcaaatcaataacaaaaagatatgatttagattacagttcctttacatgaaggatttctctctgatggaaagacttgctgaacccttgatataataggcttcgcaggtctttttattttgaggcgaaacagagaaaataaaatgtgttttttatagaaaaaaagattgtttttctgtttttttagtctgtcatccttgcataagcttgtatttcttgtaaaaaaagccggccgtattttgctcttttttgttctccgactccttttatagacaaaagttcatcatcatttacgggctgttttcctgacatttcttttaacgtttggtcagagaaaacaacaaatggcggaacaccctgctcagccgcaatttctttccgaaccatgcgcaatcgttcaaacagctcgtcattttcagtaatcgaggccgcttttagcgcttcttttctcgttactgataattctcctctcagcacattccttcctttactgctgacaaaaagagtcggaaacgttccgtctgacatcctgatgaaatcgtcagaaataagaaattcgataaaatcactgatttcccctacggattgatgttttaatatcccatatgttgagagatcggcaaagccgttttcaagaacttttttatttttagatccggcgagcacttgggcaaccatcatcttaccaaagcgttccttcatgcgaatcatacacgataagaccatttgcgcctcccgtgtcacgtcatgagccatccttgtatcagtgcagtttccgcactgtccgcacgcatcaggctccttttctccgaagtacataaggataaaacgctgcagacagtcttccgtgtgacaatagtcgaccatttgcctcagcttttttaaatcctgcttttgtttctcttcatgttctgattgttcaattaaaaaacgctgcactataatatcctgcggtgaaaacaggagaacgcactcgctgtcaagaccgtcccgtccagcccgtccggcctcttgatagtagctttccatatctttcggaatttgtgcatgcagaacaaatctgatatttgatttatcaatgcccattccgaaagcagaggttgccaccatcacttgcagctcatcattaagaaacctttcctgctgctcttttctcacatcatcagccaagcctccgtgataccgccctgcattgacccgatttctttttaatcgctcataaatccggtcagcttcttttctggtcgctgtatagataatgccagcttcatgtttgttgttttgaacatactcgtcaataaaacgatccttattttctccctttgctactttaaaggttaaattgtctcgggaaaatccggtatatacggtgttttctttttgtatgtgcagctgtttgcagatatcctcgtgtacctcaggggttgctgttgctgttaatgccatgatgacaggattgtcatgtaattcacggaataaaatttcaatatttctgtagcttggcctgaaatcatggccccattgagaaatacagtgcgcctcgtctattgcaaccaaagggacatcaatgccctgcaaaatccgaataaactccggtgacgttaatcgctccggtgtaatgtaaaatagcttataggccccttctttaagcccagtcagcctttcatatatttcctgactcgattgtgtgctgttaatgtacgcggccttaatccccgcttcttctaacgcatcgacttgatccttcatcaaggaaatcaacggcgaaataacgatcgtagtcccttcaaacatgagtgccggaatttgatagcaaattgatttgcctcctcccgtcggcataatgcagacggtatttcgtctttcttccgtcaccgagcggatcgcttcttcttggccattgcggagcttttcataaccgaaataatgggccagaagggattgggctctatgtaacataacgtataaacctcgcttttccttgaatttcttccatcatatcataaaaaaacggtcttcatttcttccacacagaaattgaatttttgctataccaaacctttttaaataaaataaaaagccatttcccaaaaggaaatggctttcgctacgtcttgccgtatgcaagtaagaaagttttaaaccaccactcctcaaagtgggtgtttgcagaaacgttcctgtcgtcctctgcaatggaggcatgacattccggcttcgatataaaactccctattacagcttaaaggttaaaacttaattaacaatacgcacaaagtagcttcttttatatagtacaccatcagcagctttttatcaagagaccagaacaattgtttagaaaaactttttccagccgataaaaacgatttttcgctattatatccggagattcgacaagtcaaaaatatattacaataaaaaaacagccttttttcgcaaagaggattcatcactttcttctattataatatgtatacaaaaaaactcctatcgcccaatgataggagtctttgtttcattagaattttgcagcaagatcttttgcttcttgtaaacctttttcaatgatttcttgcgcttgatcaggtgctgcgttatgtccttcgatgacaactgtgtgcaagtcttgaacaccccagaaaccaagaactgttttcatgaagtttaatgacatttcaagtgcagccattggtccttctgagtagacaccgccgcgagcgttaagaagcgcaacttttttgcctcccattaaaccgactggtccttcttgtgtgtatttgaatgtaacgcctgcgcgagacagataatcaacataagtatgaagcactgctggcactgtgaagttccaaagcgggaatgcgaaaacaactttgtcagcttttacaaactggttcagatatttgtcagcaattgctgcttgttttttctcatcttctgtcatttccattccttgacctgctttaaatgttccgttaatcatatctctgccaaggtaaggaaggttttccttatgaagatctaattcaaccacttcatcattagggttgttttctttataagcagctaagaaagcttcgtaaagtttagttgaaacgccttcttcagctgtacggtcgcttgattttacaaataaaactgtagacatttgtattcctcccggtaaactttttatatttacttacaaatagtatgttactttcttttttacgtaaagtcaatcactttattttgaatatgagattttttttcaaaaaaaagcaagtacatctaatatcggtgtacttgcttgccatttttacttcgaatcttgttcacgatccaagatttcatacgtctgcgagcttttttgatcaattgtttctttgttggataagtcttttacctgttcatgaaactctctttcataagaaggagcatctgtctccagatcatcctccacattagcttgagcctcaactgtcattcttgcatagggaacagcttcaagtctttcgtaaggaatgtcttggccggttttttcacacacaccgtaagttccgtctttcatcttttgtaatgcacggttgacctcctctaacagctcccggtcaatctctttcactgtttggtctgtcatccggtctgtgacgagcgtcccgtggtctgccatatggttgtcaaccccgttggaaagctcccccacttcttccgtcattgattctgtttcctttttctcgccagacaattctttttgcatatcgagcaatttatgatagagatgctgtgtttgttcttttgtcagtgccatgtatatcctctcctttctatcctgtttcccgttttgccttctgtcaaacatggaaacatcgatggaaagaagctactgcctttttgaacggatcgtgaccgctggcgtcgatggtgcttcgggttttcgttggcactttttgtccttctcttctggcggtatataataggttgcgcctatatttaatctgccgctcagttcatcaatggtcagctcgccgaattcaagatgatagtcaattttttcgacattcagcgtttcaatatgtatataggtttcttcagactcctgtttgctgctttgtttttgtttctcaatcactgagagtctttcttcacattcacgcagtttgtcaagttctggtttcaagcaaagcctgatcagcgaccggaacatttttttcatgacatcacgaccctttgcatactcctctttcgtctacatatataatgaggtatataccatagaaaggagaggttttcatgcttccgactaacatcaatatttctcatctcaagactaactcgataggcaccggctcatcccttacctttggttctgcggagttaaggaacaggtgctctgctatcaaaagaaataacggttttggggaacaaaatgcagatgttattgttatggtcattccgattgaatcaattgatgaccgtgatggagcagatgcactcagtatgaaaatcaatcatcaataacaatggttttcgcttgaccttcgtctttttgaatagtgatgtataggattccgtctttaaaaatggcattcatctttccatgaagatgatcggaaagctgaattttcttctcaaaacttccgtatttcccttctttttggcgaaagtcctgttcattaaaataggaaaagcgctgccccttcaccactaaataatctccgtacgataatatgtgaacgtcttgtttacggtagcctggaagataaattaaaaactgcacttccgcaacggtatctacaatatccatgctcggaaatgaagcatctcctttccctcgctgatcttgctgcgcaaacggaaacggagattggccatttgtcataaaaggggttttttggtcttcatcaaatacctgtttccaaaagtcaccgccgtacatctgctgtgcgaattccatccactgcttcatcttttcgaaatccatttgaagccccctgtcttaacatactttataaccgccagcatacaactatagaaaggaggtttgcctgtggttcaaccaactccgtatatcaatattaatattttcatgctgaaaattaattcctttgaaaatgcttcagcggttaacgtaggacaaaatttattggcagaatggcaaaattcagataaaaaaaatcaaggctacggacagaattttggagatgcgagcggatttatgggcacgagaagccatgtggatgacagagaccaaattgattctccggcctcttttgaaagtgaagcggttaactcctcaatcaaaaggaagtgatgagatgttcttttcaccctccgtcgtgaatgtcggcggatttaaaatcaatacgatggatcgaggttcctctttaacactcggtccgtatcagcaggtcgattactttttatcagctaaaataaatcaagggtttggagaagaaaatggcgactttactcctcttgtcgtaccgatttcaaatgtattagatgcagatcttgttgattcgaactcagcgaaaaacagtgtggtgtaataagaacagggcgcacatgccctgttttttttataaaaaaaagcctaaccattttttgaacggctggctcatcaaatattcagctgcacaaatgctttgtcagcaccgcctgaacctcgcttaaatcggtgtctttcgcaaattctaattcgaacgttttgcttcttgtcatcaataaaagcccagtgtccggatcaaacattcccgcttcttgaatggcaaagctttcaattgttttatatggaagaaatacacgaaccttctttttggaaaacattttattgtcaaagaaaatgatccgcttatttgtaaagcaaatttggtccactcggagcttataaatcgattctattctttccccttcaacgagcaaagcctcaagcttctttgcgtccgttgatctgctaacagaaaaaatacccaatgaagaacccctctttctgcatttatctatttgttttatcattcactacataaaaataagtcctttatccctatataagaatacgacatagaagacatttaaaccattacgaacagattacatttttcaaatttttgatttgttttttggcttttaagctgttgtcatcaagtaatacgcacatatagagaaaaaagtttcaatattcagcaatgtttttataaaaaagcggtttttaatgatttttttaattttgttttatatttcctgttttaaccacaaaaaaaccgcagctgagctgcggttttatgtatcgactgcttttaacaaaatctgtttgatgcttcaaggaagcattacatctcttcgaagtattctttataatagccgccgactttattcgtattgtcgaccacaaagagaaactcctctgtttcattttttacttcatattcttttcccggcgttaaaacgcggtttacgatatatttttttgcgtttgtctgcacacactttacttttttaattgtttctttttcaagccaatttttatgaatcatgatgaaatctccttttcttatctataagcttattgtagcttttttcttttgtaaattgcaatatcggttattcattgattttgccttgatttctattatagaatgtttgtatacgcttacgtttgaagcaactatcacagcttatttctgctattcaatccaggaatcaatgtgctatcaccaagaatctcagaacagaccataaaaaatgactggaggtttgttacggatgagttctttaacgatgcaagtgacgaaaaggctggagacatttttacagggaacaaagaagctttatattgacggaaagtttgttccgagtgcctcaggggcaacctttgacactccaaacccggcgaccggcgaaaccttgatgacgctgtatgaagcccaggctgcggatgtggacaaagcggttaaagctgcccggaaagcctttgaccaaggtgaatggagaacaatgtctccagcttcgagaagcagactgatgtataagctggcagacttaatggaagagcataaaactgagcttgctcagcttgaaacacttgataatgggaaaccgatcaatgagacgactaatggagatattccgctggctattgagcatatgcgctattacgccggctggtgtacaaaaataacaggacagacgattccggtttccggcgcttattttaattatacgcgtcatgagcctgtcggtgtcgtcggccagatcattccatggaatttcccgctcctgatggcgatgtggaaaatgggcgcggcacttgcaacaggctgtacaatcgtcctcaaaccggctgaacaaacaccgctttcagctctttatttggcagaattaattgaccaagccggtttccctgccggtgtaatcaacatcatcccaggattcggtgaagatgcgggagaagcgctgacgaaccacgaagcggttgataaaattgcctttaccggttccactgaaatcggaaagaaaatcatgtccaccgcagcgaaaagcattaagcgtgtgacattggagctgggcggaaaatcgcctaatattcttctgccggatgcgaatttgaaaaaagccatcccgggcgctttaaacggtgtgatgtttaaccagggtcaagtctgctgtgcgggctcacgtgtcttcattcataaagaccaatatgatgaagtggttgatgaaatggcgtcctatgctgagtcactccgccaaggagcgggacttcataaagatactcaaatcgggcctctcgtaagcaaggaacagcatgagcgcgttctttcctatattcaaaaaggaaaagatgaaggagcaaaagcagtgaccggcggaagctgtccttttgaagcaggatattttgtcgcaccgactgtgtttgcgaatgttgaagacgaaatgaccatcgcaaaagaagaaattttcggacccgtgctgactgcaattccgtacgaaacagtcgatgaagttattgaacgggcaaaccattcagaatatgggcttgcagccggactatggacagagaacgtcaagcaggctcactatatcgcggaccgacttcaagccggaaccgtttgggtcaactgctataatgtgtttgacgcggcgtctccatttggcggttataaacagtcaggactcggacgagaaatgggatcatatgccttggataattacacagaagtcaaaagtgtatggataaaccttgaagactaacatgtatatttaaaaaactgctgcctgccagcagtttttttctttctgtaatggcggtaaaagacgctgaatatatatgcttctgaaggagttgagcgtgatgggcacacttcaggagaaagtgaggcgttttcaaaagaaaaccattacggagttaagagacaggcaaaatgctgatggttcatggacattttgctttgaaggaccaatcatgacaaattccttttttattttgctccttacctcactagatgaaggcgaaaacgaaaaagaactgatatcagcccttgcagccggcattcatgcaaaacagcagcccgacggcacatttatcaactatcccgatgaaacgcgcggaaatctaacggctaccgtccaaggatatgtcgggatgctggcttcaggatgttttcacagatctgagccgcacatgaagaaagctgaacaatttatcatctcacatggcggtttgagacatgttcattttatgacaaaatggatgcttgccgcgaacgggctttatccttggcctgctttgtatttaccattatcactcatggcgctccccccaacattgccgattcatttctatcagttcagctcatatgcccgtattcattttgctcctatggctgtaacactcaatcagcgatttgtccttattaaccgcaatatttcatctcttcaccatctcgatccgcacatgacaaaaaatcctttcacttggcttcggtctgatgctttcgaagaaagagatctcacgtctattttgtcacattggaaacgcgtttttcatgcaccatttgcttttcagcagctgggcctacagacagctaaaacgtatatgctggaccggattgaaaaagacggaacattatacagctatgcgagcgcaaccatatatatggtttacagccttctgtcacttggtgtgtcacgctattctcctgttatcaggagggcgattaccggcattaaatcactggtgactaaatgcaacgggattccttatctggaaaactctacttcaactgtttgggatacagctctaatcagctatgcccttcaaaaaaatggtgtgaccgaaatggatggctctgttacaaaagcagccgactttttgctagaacgccagcataccaaaatagcagattggtctgtcaaaaatccaaattcagttcctggcggctgggggttttcaaacattaatacaaataaccctgactgtgacgacactgcagccgttttaaaggcgattccccgcaatcattctcctgcagcatgggagcgaggggtatcttggcttttatcgatgcaaaacaatgacggcggattttctgctttcgaaaaaaatgtgaaccatccactgatccgccttctgccgcttgaatccgccgaggacgctgcagttgacccttcaaccgccgacctcaccggacgtgtactgcactttttaggcgagaaagttggcttcacagaaaaacatcaacatattcgacgcgcagtgaagtggcttttcgaacatcaggaacaaaatgggtcttggtacggcagatggggtgtttgctacatttacggcacttgggctgctcttactggtatgcatgcatgcggggttgaccgaaagcatcccggtatacaaaaggctctgcgttggctcaaatccatacaaaatgatgacggaagctggggagaatcctgcaaaagcgccgaaatcaaaacatatgtaccgcttcatagaggaaccattgtacaaacggcctgggctttagacgctttgctcacatatgaaaattccgaacacccgtcagttgtgaaaggcttgcaataccttaccgacagcagttcgcatagcgccgatagcctcgcgtatccagcagggatcggattgccgaagcaattttatattcgctatcacagttatccatatgtattctctttgctggctgtcggaaagtatttagattctattgaaaaggagacagcaaatgaaacgtgaatcttatcaaacggaaatgttcaattggtgtgaagccctaaaagatcagattcaaaagcgaggtcagcttgaccagtttgaagatcaaatcgacaagatgattgaggctctggaagatgaccaaacaacagaagaagattggtataaacaggccgctgccctttatcgggatattacagaatcagatgatacaagtgaaagacgcgcttatgtccctatagggaaacacgtgctgccaaagcttccttacaaatactccgccttagaaccttatatttcacgcgatattatggtccttcatcatacaaaacatcatcaaagctatgtcgatggcctgaacaaagcagaatcagagcttaaaaaagcgagagcaacaaagaattatgacttaatcactcattgggaaagagagcttgcgttccatggagcaggccattatttgcacagtattttttggttttctatgcatccaaacggaaagcggcgtcctacaggagcattgttccaaatgatagacctttcatttggaagctattccgcttttaaagaacattttacccaagccgctaaaaaagtggaaggcgtcggctgggccattctggtctgggcacctcgatcaggacggctggagattttaacggcagaaaaacaccagctcttcagccaatgggatgtaattccccttttaccgcttgacgtatgggagcatgcctactatttgcaatataaaaatgaccgggccagctatgtagaccactggtggaatgtcgtggattggcgcgaggcagaaaaacgttttgagcaggcaaaagaagtcgtttggaagctctattaaaaaaagccccctttccccgggggcttcgtgttttaaaaaatccctaccacatgcaaaaacacgatgatgatggcaacaggagatagatatcgaatgagcagcagccaaaccgcaaaccactttcgtttgagattggaaccgcttttcagctcgtcaaacaaatcctgtttcggtatttttagcggtacaaaaatcgaaatcagtaacgcacctaacggcattaaaatattgctcacaagatagtcggccgcatcaaaaatagacagatgaaatatagagacgtcacttaagacaccgtatgacaatgcagacggcacaccgacaataaaaatagcaattccgcctaaccaagcgaatcgttttctcttattgacatcgcctttcgaaagtactgcgaccaaaatttccagcattgaaaaagcagatgtcaatgcagcaaataaaaatagaagtaaaaatgctaataaaaagataattccgaacggcatttgattaaacacagtcggcagcacgttaaataacagaaccgggccttggtctggtttgaggccgaatgaaaagacagctggaaaaatcgcaattccggccattacagcaacaagcatgttcataacagttacagatacagcggactgtaccagattttcctgtttctctaaataagcgctatacgttaccatgacagatacaccgacacttaataagaaaaaggattgtcccattgcatataaaatggtattggcatcaattgcagttaaatcaggcatcaggaaaaatttgattccttccatcgcgccatcaagtgtaaccgagcgcaccattaaaatgatgaataatagaaaaagcgccggcattaatacttggcttgctttttcaattccgctgcttaccccttttgcaacaactaaaattgttaccaccataaagagcagctggcctcctacagccaaataaggatttgaaatggtacttgcaaatatcgtatcaaaaccagatgtctgcgataaaccgccagtgaagccttttataatataaattaaaatccatccgccgacgacactgtagaaagatagaagaataaagcatgtcaccatgcctaaataaccgatccaatgccacttcgttcctggagcaagtgttttataggactgaacggcatctttctgtgttcttctgcctatgatgaattcacctaacaataaaggcagtccgattaaaaccgtaaataaaataaaaataagtaaaaatgcgcctcctccgctggttccggcgacatatgggaatttccatatcgcaccaagcccgatagctgatcctgccgcggctaaaataaagccgagcttcgaagaccattgatttgcttccttcaccgtatcactcctatttgatctaaccattataaaagttcattgtaagaatatcttcctatatagtcaagaacattttgattagtttacatcttatatctatatacatctgccaaaaactaatattgaattattcagaaaattatttataataagagaatgttatgaaatttgtaagaatttctgctgaagttcttgataagtgtgttaggagtgtttttatggacatcattagaaaaataagtcatttcgcaggacaaacctttggcatatgggtcattgtttttgcagtgctgggattttctttcccatctttatttacgtggatcagttcttatattacgatttttcttggcattatcatgtttgggatgggccttacactgcaagccgatgatttcaaagagctggtcagaaagccttggcaagttattattggagtaatagctcagtatacgatcatgccgctcgttgctttcggcctcgcatttgggcttcatcttccagctgaaatcgcagttggtgttattcttgtcggctgctgtcccgggggaactgcatctaatgttatgacattcttagcaaaaggaaatactgccctttctgttgcggttacgacaatttctaccttattggcacctgttgtaacaccgttgttgattatgctgtttgccaaagaatggcttcctgtctcgccggggtctttgtttatctcaattttacaggcggttttatttccgatcattgcaggtctgattgtcaaaatgtttttcagaaaacaagtggcaaaagccgtacatgcccttccgcttgtttctgtcattggcatcgttgcgattgtctcagctgtcgtcagcggcaatcgggaaaatctgcttcaatcggggttgctcattttttcagttgttatcctgcataacggtatcggttatttacttgggtttttttgtgcaaagcttttaaaaatggattacccgtctcaaaaagcgattgcaatcgaagtcggcatgcaaaactccgggcttggggctgcacttgccacggctcatttctcaccgctatcggccgtaccaagcgcaatattcagtgtgtggcataacctttcaggttctatgcttgcaacatattggtcaaaaaaagtgaaaaagaaacaagctggatccaaaagcagcaatctatcactttaaatatgcatcaaaaaaggtacatcactttatcgtgatgtacccttttttattatccttctaataaaagctgttcaggatcttccagtaaatttttgattgtcacgaggaagccaaccgcttctttaccgtctacaatccggtgatcataagataaagcgagatacatcatcggacggttttcgaaacgctcttcatcaattgctactgggcgcagctgaatcttatgcatgcccagtataccgacttgagggctgtttaagatcggagttgacatcagtgaaccgaaagtccctccattggtaatcgtgaaggaacctccctgaagctcgctaagggttaatttattgtttcttgcttttttcgcaagctcgccgatctctttttcgattcctgcaaatgtcaggcggtccgcatctcgtactaccggtacgacaaggccttcatcagcagcaacagcgataccgatatcatagaatttcttaacgatcaactcatcgccctgaatttccgcattcaacagcggatattttttcaatgcagccacgaccgctttcgtgaagaaagacataaagccgagcttcacttcgttttgctcaaagaattgatctttgcggcgttttctgagattcataacagccgtcatgtccacttcattaaatgtagtcagcatcgccgatgtttgctgcacctctacaaggcgttttgcaatcgtttgtctgcggcgtgacattttttgcacttcgacaggtttatcaaagctttgctgtgcttttggagcctgaggctgctgcttttgctgaggagccggttttgatgccggtttttcgtacgcttcgacatcctgcttgcgcactcttccaagcggatctccagttggaacttgagacaggtcaattcctttttctctcgccagcttacgggccgacggagaagcgatcgttcttgattttgcttcagattgtgcttcctcgctcacctcttgtgcagctggttcagcctgtttctcttctttcacgctttccttgctttctgctttctctgtaggagcaggggcagaactttcacccgcgccttctgaaatcgtaccgataatttctccgacctggacggtatcacccgaatctttcaatacctcttgaagtacacccgattcttctgctgtcaattcaacattcactttatccgtttctagttcaagcagatattcaccctgttctacatagtcaccaggctgctttaaccattgggctattgttccttctgagattgattctgctaattcaggtaccttaatttccgccattttttcatttcccccttagtttttgcgagtcaagctatcagatacaatacgttcctgttcttttttatgaactgtcggatctccctctgcagggctggatcgtcttcttcgtccaatatattgaacgcttactccctctggtgcaatctctgtcaaatacgggctgatataaccccaagcccccatgttctgcggctcttcctgcacccaaacgatttctttcaggttcggaagttttgcaaataactctttgactccttttgccgggaatggatacaactgttcaattctcgcaatgtgaagccactctttaccgtcttctaacttattaaaatgatcactgatgtctatagacactttaccgctggataatacaagtctggttactttttcatagtcatgagaaagtcccgactgttcataaacaggctggaagcggctttcgctgagctcctgcacttccgacaccgtatttgggttgcgaagaaggctcttcggcgtcataatgacgagcggtctgatttcttcacgaagcagcattttagcctgtcttcttaaaatatggaaatactgtgccgcgcttgtcaggttggcaaccgtccagttgttttctgctgcaagctgcaggaatcgctcgattcttccgcttgagtgctcaggcccctgtccctcgtagccgtgcggaagcagcatgactaatccggatttttggccccatttcgcgcgtccggcagaaataaattggtcaaaatacacttgagcagcgttggcaaaatctccgtactgcgcttcccacaaaacaagcgtttccggtgaatgcacgttatagccgtattcaaaaccgagaaccgatccttcagacagagggctgttatgaacagcaaatgatgtgctgcagtcagataagtgatgaagcggcacaaattcttcgcccgtctcactgtcatgaagcacaaggtttctttgggcgaacgttccgcgctcggaatcctgtcctgttaaacgaatcggtgttccgtctttcaaaattgaagcaaacgcgagtgattctgccaaagaccattccacttttctgtcatcatcgaacgccttggcgcgtctttctaaaatgcgctttagcttgccgaaaacattaaatgactccggccagttgatcaattcgccattcagcttgcggagcacatcaaaatcaatcgaagtgtccacatctgggaaaccgtttgatacaggctctggaagttcaatttcacaggcagtgtgttcctttttagacggaactttctgatatgcatcttcaatgcgcttcgttaccgatttttcgatgttttgaacgacttcctcggtaagtacgccttcttttaccagcttttcagcgaaaatttgtttgacggtcggatgctttctgacagcatcatacaacattggctgagtggttgacggttcatccatttcgttgtgtccatagcgtctgtacccgatcaaatcaatcagaaaatccttgttgaatgtttttcggtattcgaccgcaaacttaacagctgaaagacaagcttcaggatcgtccgcattcacgtgaacaatcggaatttcataacccttggccaggtcgctggcatattttgtcgatctggattcagcgctttctgttgtaaatccgatcatgttattggcgataatatgaatcgcaccgcctacttgatacccttttaaagaacttaaattcaatgtttcagctacaattccttccccagggaatgcagcgtctccatggattaaaatggccagcgattttgtttcatcttgtaccgggtatccgctttgtgttcgcgtttcctgtgccgctcttgtgctgccttcaacaatcggattgataaattccaagtggctcgggttgttcgctaacgtaatgcgcgctgattttgtttcagcgtcttgaagctcccgattcgcccccaaatggtatttgacatcccctgtccatccgtagctgattccaattgatccctcagacgggacaagatctttattcggcgcatgctggaattcagagaagatgatttcatacggtttgccgagcacatgtgccaagacattcaggcgtcccctgtgcgccatcccgatgttgacacttgtcgtgcctgatttgacagattgtgcaataatgtcatcaagcactggaacaagagcgtccagaccctcaatggaaaagcgcttctgcccgacgaatgtgcggtgcaaaaactgctcgaagccctctacttcagtcagtctttccagcacagccgacagcttttcagctgagttcttctggaacagctcgccagattcaatctttcttgtcagccactcgcgctctttgaagtcatgcacatggtcaaattcaaaagagatggttcttttatacgtatttcgtaaatactgaatggcttctaaaccgttcgtaatgtttttaggagcgtctttgcagatgacagacgcaggtattgcttttatttcctcttctgttagcccgtaatcggataatggaaaaagttcgctctttttctcatcctttctgagcggattgacggaagcgttcaaatggccataggttcgaatatcttctgcaagtctgactgcggatgcgatcttttgaatcagatcggctgtaacacgtcccttttcttttgttcccgaggcctcttttatatcgcttggcggagcaccgagctcgtcgaacatttccttcaaatccgggtcaatgctgttcggatcctgggtatactgatcgtaaagctccagcgcatagccgaggttcggaccgtaaaaatcttcccaattcattcgttgtttcatactattttgaaacatttgaatattacccccaacttaaataatcaagtgatcgattcactatcttgaaataactttcgaacgctgtgtccaaaattatgtaataaaaacgcttccaacgatattttaccactgtttgcaatttgattctaccttgattgttcacaaaatagtaaaaaacctttataaaaaacaaaaaatttaatcattcgaaaaaacaaacgccaaaaagcataggattaagggctatcctatgcttttatgaagcagttttttcagcagcggatacaaaacatccggtagctgatcaacatccgggacaaatatactgaattttccgtacatatcctgaatcgtcttcatttgcgattcttctatttctgagttggagagaaaaacatttatcacttctattcctctttttcgggcttcgataaccgcctcacttgtatcgacgatcccattttgttcgtagccaaatgcggccggctctccatctgagaaaacaattaagaacttttgcgcctcgctgcgatgcagcatttttttcgtcatctgcctaattgcgtacccgtcacggttatcttcttctggctcaagctgcataatggccggtccagaatcttgtcttaatgatgattggaagggaataaccgtattgaaatagtttggttggcttgtttcggttgcatcatttgtgtcctcccagaaaccgacaatctgatgcggaaccgctaccgatttcaacgcttcgtgaaacagcacgattcctcgttttgtttcgtccattttgtcgaacatgctggcggaacaatcgaccagcaatgtaaaaactgcgtcgatttctgtagacggttcttgctttttgtagaacaggcgcggatttcgctcagtgaagtaacgaagaagcttattattcagtctcccggcatgaagatctgttctcggcaatgtttttttatgctccagcgttttttgaatcatttgtttcaaacgcttttgatacgattcaatcgtttttgcctgctgtttataagaaagctcctcttcactagttgccggctgcggttctttataaattggaaatgcatatttattttctttgccgtcagccatacccgctccgttcggctggtctttttgagactccagcgcttccagcttggaatagtctttccgtttcgtatgtctggctgatccttgaacagagccaagggcctgatctccatcgtcgccttcccttgaagcatcttttcctaaatctgattttgcgccgtgttcaatatcaaattgaaggaagcttttagacggtgcttctgtttcccggtgccatgtcggcatttcttcttcatggatatcctcatcaccgtctgatttttttggaagcgtgatgtcatcactcagcttcggcgcttttttctcttcttcaaataacggctgttctgcagcttttgcgtagtcaagctcaggcaaaaagaagtaggtgttcaacatgtctttatcgagcacctcttcaagtccgtccatgaggtcctcaacaattttcagaacctgccgtgtcgaatctacttcatacacacgcaagagctgctgctcaataaacgggcgcatcagatcgatatcttcacgcatggatggaagggtctcgagcggcgattccgctgtgagcttgacatagatcgcgcaaaagagcgcatcggtaaaaatgcttcgttccaaatttaaggtcagctgggttgagaaatgttttctgtacatgtcttttcgcttcgcaaatacatgtttcgtacccggacgctcacgtttgatgcattcttcgatcctaatgtcttcaagcagcataaagagctgcttggcaaaacttttaaaggtgagatgacgatggatatcattcaaaaagttcgcaaactcatgcagcgagctatatcttgttccgactgaacgcaggtagacgtcgcttttcagacccgcttccatgtcctcagctgccctgtctttccaaaagtggctcatatagattttcttttcaaatggattgtaataggactgaacgccatactccacttctaccgcttcactcttggtgagtgttttggccaaatcagtcagcatcataaataaaaatgaatcaatcgtgctgtcgttaaatttgataaatttcatcgcagccccctcattcaaacagagtttctgcaatatttcggacggccgctttttcccgatcatcatcaagcttttctacaattccccgctcaatggcacgacgcggcggaatataagcagctaaatcacatgtatcgattaaagctctgatggatgccgcttcttcagacacctgtccgttattggcctgaacgatcaagtcagaggaaagcgtgataaatctgtcaatcaatttctcgtctttcaaggctgactgagacatgagcacttgtttcagcagctcgcctttaatataaggcacatcaatgatgacaaaacggtttttcaacgcttcattcagaggaacagttccgacatagccttcattgatggctgcaatgactccgaaaccgcttttagcccgtatgacctcgcctgtaaacggatttgtcatcatttttctgtaatctaatacaccgtttaaaataggcagtgtttccggcttcgccatattgatttcatctatataaagaaaatggccttccttcattgcctttgtaacaggtcctgaaacaaactcgattgtcgcctggccagattgattttcaatcgttttataaccgaccaatgcctcagcatccaagtcgactgaacagttgacgctgtgcatcggtttatgaaaatagctggacaatgtttctgccaactttgtttttcctgaacctgtaggccctttcagcaggacattttttcccatggctaatgcaataatggcgtcaaatagaatggcttcatcctccgcctcatagcctgatgttcctataagcgattgaaactccggggaaataggctgctctttatatgataaaagcttttgttgtatatcttccggcaatgttaagtgctgtagttgtgttgtcatagacagattccctttcctattcatattccttaacgagtatactaaaaaagcccctgtatgctcaatacaaaagggcttggatgatattactgcttctcgttatttcccaaaagggctccgcagacaatacgcgcaccggaattgccgcttgggtttgtcagataatcgtccgcttgttcatgaataataaatgcacttccgtcctcgtcgagaatatttagtttacttccttttttcagtgaagtgtcaggcgcattcattatgacatctacctttccatcagcaccgacttcaaggttcggcagatctccggcatgatgccccatcggattattgaagccgtgttctttgttcagtggattaaagggaccgcccgctgattcaaaatccggcctgacacaagaacctttctcataaatatgaaaaccgagagaagcacctggacgcaggctgtttgcggaaatatgaatatcgaggccttcatcatctgattctttgatctctataaagccgactgctttcccttcacgattgaccaactggacatgatgaccaaacgctgacgtttcaaccacttttttttccggcacccggttaggagggtctggaggttttttttgtccgcatccggcaactcccagtgccgtcagcatcatcaacagcaagagacggtacatactgtctcccccttgttttttctaacagtgtggtcaatcattgtctggtataaacaaaaaagcctataaaaggctttttgtcatactcatttttaaaaataacttcttgcgcccaagtaccgctgtttccaatacgaattgctgagattggaaatgtcgacgcccgatgagcttgcatgaataaaatcaccgccgcctagataaatccccatgtgagacgggccggatttatatgtggtaaagaagacaaagtctcctactgacggctggctgactttctgcatgacattccaataccctgccgtactcaatcttgatatagatgatacattattaatgaggtaataaatgaagccgctgcaatcaaaaccggcaggcgtgtttccgccccatcggtaaggcactccgacatattttttcgcttccgttatcattctgtcaatcttcgagcctatttgaatgtttgaccctgagttatcttttggctttgttggctttgtcggatttgaaggattagattttgatgctcccgaaatagtcagaacctgcccgatttgcaacacatccgatgataaattgtttttatcacggatgctttggacagtgactccgagccgatttgcaattttccacagcgaatcgcctgcttttaccttgtacgtcgttgtttttgagggattggagtttgacggcttttttgaaccgctgtttccgctcttcggtgagctgcttccttttattttgagcacctgtttagggtaaagtgtatctgatgttaagccatttaaggtttttaattcagctacagtcatatttaagctgtttgcgattttccacagtgagtcaccaagcttgaccgtatatgtactttttgaagaacctgaagaattggaaccgctgtttttctttgatccatttgatccgcttgaactgcttgtccctttgatcttaagcttttgccccggacgaatcaggtcactgctcaggctgtttaagcttttaagctcagaaacactcattttatgatttttagcaatcatccatagggaatcaccatatgcaactgtgtatgttgatgttttgcttgaattagatggggatgtcgtgctttttttgctgctttcaggaaccttaagactttgtccgacataaagcaccgttgatttcaatttgttttcggatttcagagctgatattgtcgtatcatactggcgggaaagtttccaaagagagtcaccgctttttacttttatcgtttttgcttccgcgggtgctgcggccatcgacgacccaacaactgcagaaacagccaagccggctacaatcttctttttcattcattcaacctcctaaactgttttttgcaaaaacagctagtattttgtttccaaaaatggcacgcaactgttttatcgtcaatttttcagcaagttaaacccttttcaaacatttggcagcattttcagcatcgttcgacctttaaaccttcaaataaacatctaacattttacataagcacgatatgtttttcgaaagtctaaggaactatttaagcgagggtaaaaatgatggttttctattgatgaacgaagcagtttctcctcctttcttgtctatttttctaatcaattctctatcggcgtgtcaaatccctcttatgaaatggcaaaaagcctgttctttcgataagaacaggcttttacactatgcatttgctgattgagttttttgttttacagcttcaagaatgctatcggccgcttttttagagccgcctgccgctttcagtgattgtccaatttcttttgccttttcagcatacgaaccattattcattacatcttgtatcgtctctttcagaaggctttcagataattcttctttttttaacacttttcctgcgccgactttttccacctgatctgcgacaacaaattggtcgcctcccatcggaatgacaacgagcggggtttcaaaatacaaaccttcacttgtgctgttcattccgccgtgtgtcacaaataagctggctcttttcaagatctcaagctgagggacatacgggcgtacaatgaaattctccggaatgtcgtttaactcacttgttttaatatgcttgccgatggaaagcacaactttaccgtcaaagtccttacacacttcaaggcattgattaaaaaactgcttttgattattaaaaatggttcccattgaaataaacagcacgttttcattgtcaatctgatcaaatgggaaatcattgtttccggctctttctgtaatggaaggaccgacaaatacatatcgctcgccaaattgctcagccagtggctgaaatccccttgatgtaaagacgattgtcaagtcaccatcagctaaaaaaacatcaaatggcttcttgatctctgcttgaaaatcagcatttaacgtttctgcaagctgctggtatgattcataatgaggcgaatcttcaagtgatcctttcatgtacgctcccatcatttccttcgcaaattcctcattcatcgcaaaggttgtacacaatgaaaatcttggcagcttcagcatgttggcaatgactttacccgcgagaagatggtgatcatatatgacataatcatacgattcatgtttgacttcctcataaatatgagtcgcgatatccttacaggctttcaaaaaagcgcagagcatttctgtgaaatctctttcttcatcgccggttgcgtttttcccgaagtaatctcctctgaaatcatgatactcacgaaactctatatcaagagctgtgattttttctttatattccttcactgcgtagtacgtaatgttttctccccgggatttcagctccttcatcacaccgatagagggattaatatgcccttcaccgggaaaaccgatcattaatacattagccatgcgacagcacccttcctttgaaaatttatgtaatattttatacggtactataaatacataaacaggtaaagtatttcacttaattaatattcattacatataacttttctaccagtttatatttcctgtcttcaagacaaaaagcattcagcttgaagcgaatgctttaataaagatacgaattcagtcattttgtctcatgataggattcttaatcaggccctttttattatttttacgttcttggtgaaattaacggatataatacaccgtctttggcaaacgacatcttccctgtttcctctgaaaccacgagcaccagtgcatccgtatagcccgacataccgagagccgcccggtgccgggttcccaaatggatatccacttccttcgtcgtcagcgggagcacattggctgctgacacgagtttgttttccctcactaacaaagcgccgtcatgaagagggtttccggggaaaaagatgctttcaattaatgaagagctgatctcggcgtgtagggaggtgcctttttgaataaaatgttcaaccgggtccgctctttcaatcacaattaaagctccatgcttatgttccgataaggctttaatcgccttggccagctcaataaatgccggcgtaaattcctcaatgtatgattgcaaataaaaggaggatgcaatcccctgcatgtcctgaaatatgtgccccaaatcatctaattcacaaaggagacactggtctttttcgtgaagcgttttcaagattagagatgcatcacctaatatttgctctaggtacacctgtattttccccttgaacgcattttctgatatctgctcatagcgcataatcttcatctcctgttcaaatttccaacttttcacgaatgcttatcttattgatgcacattctattggtaaaggagggatgtaaagaatggaaatcgaaagaatcattcagtatatttgcacctttttaggcgtgatttcgctttcttttatttatgcccaaatgtttagaaaaacgaaaccgacaaaaaaagaataggcccggcgttcattgctttttatacataaaatgttataatttctctcgttatgaaaaagaaacggagatcaatgtatgaaagaaactcaaaacgcccgggaaaaaatcaaacagctcttgcacattttaataccgatattcattacccaggcggggctttctcttatgacttttctagatacggtgatgtcagggaaagtcagccccgctgatttagcgggtgtcgcaattggctcaagcctttggacccctgtttacacaggacttgcaggtatattaatggcggtcaccccgattgtcgctcagttattaggcgcagagaaaaaacagaagattccctttactgttttacaggctgtatacgtggccgcgctacttagcatcgccgttttattgattggatatgctgcagttgaccttattcttggccgattgaaccttgatattcacgtgcatcagattgctaaacactttttaggctttttatcactgggaattttccctttatttgtttacaccgtgttgagatcattcatcgactcattaggaaaaacgagagtcaccatgatgattacactcagttctcttccgatcaattttgtattgaattatgtatttatcttcgggaagttcggaatgccggcacttgggggtgtcggcgcggggctggcatccgctttaacttattggtgtatctgcatcatcagttttttcattattcataaaaacgcaccgttttctgaatacgggattttccttaccttgtataagttctcttggaaagcatgcaaaaatttgctcaaaatcgggctgcctattgggttcgccgtgttttttgaaacgagcattttcgcagctgtcacgcttctcatgagccattttcatacagtgaccatcgcgtcccaccaggcagccatgaattttgcgtctcttttatatatgctgccgcttagcgtgtccatggctctaacaattgttgtcggatttgaagcgggtgcagcccgttttaaggatgcacgctcatatagcttaattggcatcatgatggcgatcggcttttctttgttcactgccgcctgtatccttttattcagagagcaaattgcgggcatgtacacttctgaccccgatgtgctccggctgacacagcactttttaatttatgcgctattttttcagctttccgatgctgttgccgcaccgatccagggagcactcagagggtacaaagatgtgaactatacgcttgcggccgcttttgtctcttactgggtcattggccttccggtcggttttatggtcggtacgtttacaagcctcggtgcattcggctattggattggattaatagcgggactcgccgccggagcagttgggctgtttttcaggctggcaaaactgcaaaaacgttattcgcaaaaacaacacatttaaaagaggtgatcaatcatggcaaaaaacaaaaaattattcgagtatctttcccagcatgcggaaaccatcagttcaacatggtatgaaacaatcgaggagactgatcccaattccatttatgcctcaacagatcctgttgtcattcacaatttaaagagccagaatcttgcctttaactataaaataaaccgtatttttatagatgatgaggacgtatacttgcctatactgaaagaatgggcctttgaagtcacacaggatcaagagcatttaaaaactcctatccactatattattcgggagtttgtcagagtgagagatttatatgtttcctatgtgaaagaatttgtccatctcaatcaggatactgtgaaaagcgaagaagccgaagacctgtatcacgcccttataaaagcgtttgatcttgtgattcatatttttatagaagaaatgtacaaaaacacaagccttcagcttcaggcccaaaaagatatgattactgaattgagcgctccggtcattgtgctgtttcacagcgtcggactgctgcctttaatcggagatattgatacagtccgcgccaagctgattatggaaaacacactgcatcaatgtgcgaaaaaaaaggtgacacaactgtatattgatttgtcaggagtagctgtgattgatacgatggttgcccatcagctgttcagtctgattgaggcgcttcgtttaatcggtgtttcttcaactttgtctggaatccgtccggaaatcgcgcaaacagcggttcagctaggtttgtctttcgaaggtatttccttgagatccactctcgcttcagcaattgcatcggacttaaaattaaaaaaggtataaggcttaaggccttatacctttttgattaatcattccattgatacgtccaatatatttcttcttcaaaccatgttgccataacaggttcattatttttcaatttctcttcaagctctctgagcatgccttctgtttgtgtgcggtgagctcttaacgcattcattttaatatcagctacttctttgatatcaagtacgacatcagcttcgccgagaacctcttctctgttgcgggtaatggccatgcagattgtacgcggacggtcttctttctttttgcggtacaatgcacggataaccgcttccccgcatgcatcatggtcagggtgcacaccgtgtccgggataaaatgtgacaattaaacttggttttacatcatctatgatctcttccatgatatcagctaaatactcatcatcttcaaattcgagcgttttgtcacggagtccaagcatacgaaggtcattgatatccatttctttgcaagcgttgatgagctcttgttttcttagcagcggcaacgtttcacgattcgcgaaaaatggatcgcccatatttctgcccatttcacctaaagtggcgcaggcatacgtaacgggaatgtctttttttctgtttaaggcaatgaggcctgccactccatatgattcgtcatcagggtgaggcaggattactaatacgtgttctttcattatttttcacccttttctttaaactgtgaacggtttttcactgatttgcagagaaatagccagtttaccgcccggcagatgtcccgccattaataaacggttttcttcatctaccgtgtattcagtcaagccttcagcataaatccagccttcttctgttttcaagccaacgcggtaaggcccgttgcctttgatttttgcctgatgataagtgacttttgcattgcggatatacgcaacaaccgtcatgttcttttcatttaagtgcgctgaataagaacctgtggtggtttctaaatggatatatacagggcggtccgcatatcgttctaaagatgcttgcacatcttcttttatgatcgctttcatgattgctcccctctttcttcttttaaatactctgcacgttctgtatgtaatttgaccagctgatatttcacagccggttcgagctgtgaattcacaatgcgctgaatcgcggcaaaatatttttccagcatcggttttcggagtcttggatgtgttcgtttatccaagagctcaagatcaatcgcctctgctaccgcttctgcgtcatcatgtgcgagagatcggttattccaaagtgaagcatatgctttcactatctctttatcattgtccatcgtcttgctcctttatgtcttacatacatgaaatgattatacataatatatgcatcagctgaaaagccaaaggcctcaatggctttttgacgcccgtttccacttcacttgtgaaaacgtaaacaagatcagcgcagcccatatacagctgaatgtaaaagccttcgagctggaaaatggctcattgtaaacaaacagcccgatcagaagggtaatggtcggcgcaatatattgtaagataccgacttgatacagtggcagccgtttcgctccttccgcaaacaataagagcggcaaagccgtaaacacaccggccaaaaagagaagcagccacgtccctccgctttctgcacccgctggctgaacatgtccgctgaacagcaaataccccaatgcaatgggcataatcatgaatgtttccagcgttaaaccgatggcgctcggcaggcttgttctttttttgcttaacccgtacagcccaaagctgaatgcgagcagaagcgcaacataaggaatggagccgtattggaacgccgagatgatgacaccggctgccgcaatcgaaacggccactaattgcaggcgattcagtttttcctttaaaaataaaatcccaaggagcactgatacaagcggattaatgtaatagccaagactagcctcaagcaaaaagccatggttgacagcccatatgtatacaaaccagttgatcgaaatcaggatagaagcaagaaataaagagaggatccctccgttctttttcagagagcgcagctcctgccatcctattttccattgccgcaagaaaaaaagtacgatacacataaaaacaaaagaccatataatacgatgagacaaaatatcaagagccggcagctgttcgagaagcttccaatagagcggaaacaggccccacatgataaaggaaacggctgtgtaaataacgcctttttttgtttctgaatattgcatttatatccctgcctttctttagagcatcttatattatatcacgtgaaagatctggcgggcatatactattttgtccgtgaagaaaggatgtgaagacaatgtttgagtggaacaagtactttcctttccacaatcaattttctaaagaagcattaaaaaaagctgatccgaaagaagttgaaacgtatgtcaatcgtgtgatggaaagtgtgttcggcagtgattatgcggctcaatttcctttccgcgatcctcttccccaaaaagaacagcccgccaaacctgatgcaaaacctgatattgatatattcgaaacagcagaccatgtgtttgtaaaggtgccaatcagcgaagaatggctggaacaagtgagaatcaaacacacatctcacgaattatggttggaaaacttcccaagagcagatcatccgaaaaaagtaaaccttccttgtttagtcaaacgcaaaggaacaaaagccgtctataaggatggccttctggaagtcatgtttcaaaagcagcaagactacaatatgtccgaggtagaaatcatccgataaaaaacggcctgcaatcgatgcaggccgttttttattaatagaaaccgggatatcccccgtatggcacgccggcaccaaaaccgtacggtccgcctccatatccataagggccaggaggataggcatagggacgagaatagttaaacagcgcactcccgagaaaaccgcctaataaaccgccgactagaggagcgccaaacaaaaaaggactacgcgccggatatccggctggacctgggattccgcgtaaatacgaatgatgagggtacatgaatttttcctcctttatgtctgcctatacgtaaagtattcagcaaggaagaaaaacgattgggctacggactgtctatgattgttacatcacaagccctgccaataacacacagccgagccctgtaaccgaaagaactgttgtaagcagcgtccaggtttgaaatgtttctttcatactcaagccgaaaaattcctttaccatccaaaatcctgcatcatttacatgacacgcaatgacactgccggctcctgttgcaagcaccattaacgcggggtttacactgccagcctctataagcggagctgccattcccgctgtggtaagcgcagccacggtagcagagcctagacacagacgcaaaaccgcggcgatggtccatgcaacgaatagcggcgacatgtttgtttgacggaaaaaatcagcgacataatcgccgaccccgccgtcaatcagcacctgtttaaacgctcctccccctcctatgatgagcagcatcatcgcaatttgcgaaattgattctgaaatagatctgctgatttcctgcatagatattttacgggcatatcccatcgtatagagtgcaagcaacagcgaaatgagcattgccgttcccggagtgccgataaattctataatgtcttttccttttgaatgttcactcaataataaagaaaaaactgttgccattgccataaagataaccgggaataaagacgtgacagcactgatcgcaaagcccggtgtttcattcagctgaaattctttccttggtcctaaccccgataggtttccatgcttttgatacgcaccaggaaaccgtttcatcgcaaatttattaaataaaggcccggcaatcacagttgtcggaacagcgatgatgattccaaaaagcagcacctagccaatatgggcaccatatgcaactgagatagcagttggagcaggatgtgggggcaaaaatccgtgagtaacatttaaggcggcggccatcgggattcccagatacagaaaagacatttttaattctttagcaatcgcgtaaacaatcggtatcaacagaacaagacccacttcaaaaaacagcgcaataccgatgataaaagaggcaaccacaaccgccgcctgtattcgtttcctcccgaatttgccaatcagcgtaatggcaatccgatagccgcccccagcatctgagacaagcctcccaagcatcgcgccaagtccaaacactaaagctaaatgccccagctgcccgccaattccagcctcaattgaaagaacaattttattgatatccattccaagtccgatctctactaaaaatgaaacgacaatcagtgagacaaaggtatttaattttactttaataatgagaaataacagaatcagcactccgacagctacaattaaaatcggcatggtacccctccaaaagtgttttatatgattctcgcgacaatgttttggcgtttttcatgcctagacgaacagaaaacgctttcattaataactaaaaacgtcttggttatatgattgttatcttttgatcaactaatatgttcatactaatctcctaatcaatgactgtcatcgtttttatgagcttgtctcgattacctaccgcctaacccaatgatttattagttatatgttgattaacttttggttatatgttatgttttttaaagttgactgccaatcattatatctattcattgtctggaagcaaatgagacaatatgagaacagacggataacaacttcacagaaggaggagtacacatgccattattgcgttttgatgtaattgagggccgtgatgaaaaatcgctgcaattgttattagatactgctcaccaagcgatggttgaagcatttggtgttccggaaagagaccgttatcaaattgtccatcagcatcccgcaaacgagcttataatccaagatacgggattagggtttcagagaaccaaggatctggtcatcattagtatgacaagcaaagcaagaaccgaaagccaaaaggaaaaattgtatgctctgcttgctgaaaggctagaagaaaaatgcggaatttcccctgaagacctcatggtatctattactgagaatggtgacgcagactggagtttcggtcttggtgaggcgcaatttttgaatggaaaactataaaatttcgtctccccacaaaaaaaagaagagagagctccaagaagctctctctttttttcataaatgcggaagtcatcagtatagaagcatccagcaatacgaaaaacctggatctccttattagatccggtttaaacgccaattggatgctgactgggttttggccgaaaatataaaattttgctgatttgcataataagataactcataatccccatttacaacaggttggatgctataacttattgatcatttccatgaacatgacacttttgccaatccggaaatgtcagtctgacaaatataaaaagtcatgtaaacggggtgtgaaccgtacttacatgactcaccatggaaacaaaggctctttttcagacgccgctttccttatttctcttcttcacacactgtgtcaccaggctcgcaaaattgatcggcccatgcctgcatctcttgaaatacagcttgaagcgctgttcctttttcagtcagcgtgtagatgactttgaccggcgtttcagggagaacctgccgttcgacaatctcgttttgttcaagctccttcaagcgctctgccaacattttttggctgatcatcggtattgtttccgttatctctttaaaccgtttcggcccatccattagcacatggatgatcagaccgttccatcgttttcccagcaatgagaatgcggattccattttagggcacatcgtatttcccacaagtcttcatcccttcatctattgattgacatgtattcaatgatccattacaataatctttcaagttacatttagtaagcttctaacttttctattatcataccacgtttatccgaaggaggaaacactatgacgaatactctggatgttttaaaagcacgtgcatctgtaaaggaatatgatacaaatgccccgatctctaaggaggagctgactgagctattagaccttgccactaaagcgccttccgcttggaaccttcagcattggcattttacagtattccacagcgatgaatcaaaagcggagcttcttcctgtagcgtataatcaaaaacaaatcgttgagtcttctgctgttgttgccattttaggcgatttaaaggcaaatgaaaacggtgaagaagtttatgctgaattagcaagccaaggctatattacggatgaaatcaaacaaacattgcttggccaaatcaacggtgcttaccaaagcgagcaattcgcacgtgattctgctttcttaaatgcttctttagctgctatgcagcttatgattgccgcaaaagcaaaaggttatgacacttgcgcaatcggcggatttaacaaagagcagttccaaaagcaatttgatatcagtgagcgctatgttccggttatgcttatttcaatcggcaaagcagtgaagcctgcgcatcaaagcaaccgtctgccgctttcaaaagtatcaacttggctgtaaggatatgaaaaaccttagtccgaaatccggactaaggtttttttatacaatcgcctctttgtaccattcacgagcctgttcagcttcatgctgagtcagctgatggcccccgtcctgccagtaaacggaggctgatgccccgctgtcacgcaaatagcggtaaagctcttctgattcttccttcgtgcaaagaggatcgtatttcccggcaccgataaaaacagggagccccgccatatcaggcagctcgataccccgaatcggaaccattggatgatgcagaatagccccttttaacacatctttataatgaaaaagcaggcttgccgcaatgtttgcgccgtttgaataaccgactgcaatcactcggccgcgattaaactgatgcgtttctgcagcctcgtcgataaaatctttcaattctcttgtccgcaccacaagatccttttcatcaaaaactccttcactcagacgtttgaaaaatcgcggcattccattttcaagcaccgatcctctgacaccaagcaaatgggcatcagggtctataaaccgccccaatgaaagcagatcgtgttcattaccgcccgtgccatgcaacagcaaaagtacgttgtcagatgttcctttttcataaatatgcttcattataaattcccccttttaaagttcaggtaaaatgtctgtaatttgttgtctatgtttctccagccattcaggcagttttaaggaagtccctagctcagcaaacgtttcatctgtcataaagcccggttcatctgtggcaatttcaaataagataccgcctttctccctgaaataaactgatgtaaagtattccctgtcgagaatttctgacgcaggcagatggttttcagcaataatcggcagccatttcgcctgttcctttttcttagtccgaaacgctacatggtgtaccgtaccatatcctccgactcctcttttttcaggatgtaaatggacatcaatgacaccgccgacggccgctgaggatgccagtctgacaatctggtcttcttcggccactttggtgtatccaaagctttccgttaacaattgtatggtcgcctgcgggtcgtaagaatatagcagcacacctttcattcccgtaattgcttcatttgttgtgatcccgtcaggcgtccactcgcttttgccgcttttcgcatcctccatgatcgccagcggaaggtcttctgtatcgtcaaaaataagacctttttcaccaaacaacgttttttcctctaggctcagcccgcttttctcaagacgctccttccaaaaagacagggagcctgagggaactgaaaagtacacccggcccgcttggccttttcctaccgttccctgtccgcttccttggaacggaaaaaaggtcattattgtaccgggatctccgttttgattcccaaagtaaaaatgatacgtcccgggatcatcaaagtttactgtttttttaacaagtctgagcccaagcacttctgtataaaatcgcaagttttcttgcggatctctggcgaatgctgtgacatggtgcaatccttctgttttcattttctcactcctatttatctcgatttcaagatatttattattttaaacctttattgaaaaggatgcaaaccatgtgttttgtttaaataactgaaaaaatcatttttttctaataattatcttgtgatcttttcttacaactgctattatagtgagcattatcatgtttcaggaggaaagtaaatggttaaaaaagcacttattgttattctcattcttttgccattcgttcagctcgcgcttttgccgcttgtgaatcgaatagaaccgattatgttcggcctgccgtttttccacttttggctgctgctgtggattattgttacgccgttatgctcgtttggcatttatcagatgcaaaaaaaagatggaggacttgaataatgcaagggaatctgactgcacttctcattactgctattattgttttaaccgttgtctgtatcggctttctcgccggaagagacaaatcctcacgtacttctgtggaagaatggtctgtcggcggcagacgcttcggcggtcttctcgtctggtttttagtaggcgctgacctttatacggcctatactttcttagggttgaccagtactgcttttacaggcggaagtgttgcatttttcgccattccttattctgtgttggcctactttatcgcctacttcttctcgccaaaactttggaaagttgcgaaaattcataaattaacaacactcgcggattatgcccgggaacgttttaacagtaagcttttggcaagcctcgttgccatcgttggggtactcatgcttattccgtacatatgccttcagctgagcggcattcaagacacgcttcaggttgccggcactggctatattaacgtaaaattcgttgtgatcatttcatttattcttgttgctctttacacattcttcagcgggattaaagggcccacatatacagccatcattaaggacattttagtatgggtcattatgctgtttatggtggtgtccctccctctcattcattttaacggctggacgccaatgattgacacgttagtgaaggaagcgccgcaaatgctgacgataccggcagaagggccaaaaggcatcccttggtttatcacagcatctattgtttccgctctggcactttttatgtgggcacacgccgctacaggagtttttacagcgaaaagcgctgatgcagttagaaaaaacagcatgtttttgccgctttacaatattgtgttaattttggtcatttttcttggctttatcgcctttcttgttctgccggaagatacaaatccaagactcgcgctgctgcatttgattcaaacatcttacggcggcgtggcacaaggttttgcatatgccactatcgctcttgcttcattaataccttgttccattatggcaatcggcgcatcgaatttattcgccaacaacctataccgggatttgattcatccgaatgtgtcgcaaagcaagctgactcttgtcacacgttcaatggtgtttgttgtcatcggtctcgcgctgctgtttggaatgctgtttccgactgccttagtgacacttcagctattaggtgtatccggtatggtgcaaatcttccctgcgattgctgtcagcctgttctggaagcgtcaaacaaaagaagcgacagttatcggattattagtcggccttgcggttacgtttattgtgtataccactcaatccgcacatggcatttatgaaggattctggggattggccgccaacatgatcgctgtggtgatcctgaatccgctgttcgttaaaaacgcgggatccaatcctgtcattgaaggtttatttggcaaaaaacaagacgctaatccaaatcaaaagggtgcataaaaaaaccatacgcggcagccgcgtatggtttttttacatttcttttttcagtgtttcaattgccttttccatttgcgtatcattatcagacagcttcttttgaagttctatcattaatttcgttgttgtatcgccagtcagtatgcctgtctctttcagcttctcttttttctggaactgtttgacgacagatacaaagtcctggtcatacgtactgttaacctttaccttgtaaccaagtgctttgagcattttctgagccactttgacgtttgtgcctgtatcacctgatttgtacgttttatctgcgtccaaatacggcagcttcgcgtaatcaggcagctcagctttcacttgaggcttgatgccttttttgtgaatccattcgccgtcagcagtcagccatttggcaactgtcagtttgacagtagagccatcatcatattcttttgccgtttgcactgtacctttgccgaatgtcgtctcgccgattaacggtacgtttgacgattcatgaagggcagcggccataatttcggctgcgcttgctgtaccgtcatttactaaaacgacggtcggcttggtcactttccgttctttttcggccttcatgacttcttttgaaccgtttttgtattcaacctgcatgatgtttttccctttatcaatgaacaggttgctcatcgtaatcgcctgttccattaagccgcccgggttgcctctcaagtctaaaatatagcctttggcgccttttttctctaaactgtcaatcgcatctgtcagctctttagctgttgtttcagagaaagaagtgatttgaatttctccgatgttgttgtctttcatctctgaatagacagtctctacaggaatggtatcgcgcttaatggaaagatcgatattccccactcccgctctgttcagttcaagcttcacctttgtgccctttttgcctcggattaaagcgacggcttcatttacattcatgccttttacgctttttccatttaccttaatgatttggtccctcggtttgataccggctttttcagcaggtgaacctttaattggggatacaataaggatttctccgtctttctcctctacttgggctccgattccttcaaaagatgctgaaatcgtctcgtcgaatgatttcgcttgctcttgatccatatatgtagaatacggatcatccagtgattgaatcattcctttaattgctccgtctactaatttgtcatcatctgttttttggtaataatcacttttgatttgctcatacgctttatttaatttgtcgaacttgctgtctcctgtgcttgctgatttttggcccaggatactggaattgcccgtaataaataaagtaagcgccgaagcgacaactgcagtgatcagcacaataaaaaacagttttaattgccgtttcaattaaacaccacctttttcttcttacattattatcatggacgaattcttattcgtcaactcggagcagaaatgaaagagaaacgcccttcttttgcttttcataaacctatgtctttatacgacatatgataaggaaaaaggaggattcgatattgagccgatatttagaaatgctgtccttattcggtgtcgcaggggcgcacccaggcgggctggctttttcaaaagcggtcttgcaaaaggctgcaccctctccgaatcagccgattcttgatgccggatgcggaacagggcaaacggcggcttatttaggacatttgctgtatcctgtaacagtcgttgataaagatcctattatgcttgagaaagcgaaaaaaagatttgcgaatgaagggcttgccatccctgcataccaggcggagctggaacatctcccgttttcttctgagtccttttcctgtgtcctgtcagaatcggtcctcagtttttcacgcctgacatcctctcttcaagaaatttcaagagttttaaaacccggcgggatgctgatcggtatcgaagctgctttaaaaaaaccgatgccccctgcagaaaagaagcaaatgatggatttttacggatttacttgcttacatgaagaaagcgaatggcataaactcctaagatcctatggctttcaaaaaacagaagcgatgacacttcttccggaagacatggaatttgaaccaaccacagaaatggatttatcgcaaacgattgatcccatctattacgatacgcttcaaactcattatcagctcatgcagttatatagtgagtacatgggtcattgtatttttatcgcgtacaagtaaaacggcgtatcgccccctgttttcgtccaacctttttttcctatctatcatatgctgatagaaagtcaggataggaggggaacaatattggagagatattatcatctttgcaaaaaccatcaaggtaaagtcgtcagaattacagagagaggcgggagagttcacgtcggcagaattacccgtgtaacaagagacagagtttttatagctccgaccggcggagggccaagaggtttcggttacggatattggggcggttattggggatacggagcggcttacggtatttccctcggtttaattacaggggtcgctcttgctggtttattcttctggtaagcatagaacaaatgctagattcaccagacacaatgaagcccgcttatctagtgtaagcgggcttttcattttaaattttcttcactttttcaaagtactcttcaagcgttaaatcattatcttggatgacctttgcggcttttttgcctacatagcgcagatgccatggctcatattcatatttcgtgatatcttctttatttttcggatagcgaatgataaagccatatttataagcattgtcctgcacccatttcccgtctgccgtgcttccgaacgcttcatttagctcaaagccattgctccggctcgaaatgtccatcgcgaggcctgtttggtgctcgctttcacccgggtaagcaaccgcttcctttgccttcttttccccttttaggcttacttcattgtcaaaaatgactttctgtctgtcatacgaacggtaccctgagacagctgccagttcatagccttcctttttggcagcatcgaacattgtttttaatgcgtcggccgcttcttttctgatgtaacgtttttgaatcttttcttcaaaagaaaactctacatctggtatgacaagatcgctaggttcatagtttccgggcagtgcatattgtttattgacaagcgcgagtatattttctggattttgaatggtttccagaccatcgacttttttaatatcattgaaatactggctttccaatgaaaactcactgttttgagtgtttgattttttgctgtcagctgttttttgttctgtttgctttgtttctgctgtggttttcgtatccttttgagcatctccgttcgacatgctgcagccggctccgactattgccgttacactcagagcggcagccagtgagaaccatttaccggactttttcatattacattaccttccttttatcaatcgtttccgcattcataaagaagaggctgccggcacccagcacgcctcttgatatattttattgtgatacggaatgtaaagccacttctatcatatcatgaaatgtcgtttgacgctcttccgctgtcgtttcttctcctgttaatacgtgatcactcacggtgagaattgacagggcttttcttccgtgcttcgctgctaatgtatacaatgcagttgtttccatttcaacgccaagcacaccgtattttgcaagtttttcaatttgcgaatcgtcattgtagaactggtcagctgtaaatacgcttcctacagtcaccggcacacctttatcctttgcggcatcataggcattttttaaaagctcgaaatctgcgcaaggcgcaaaatcaacgcttccgaaagcaactctgttcatttgtgaatcagttgaggaggtcatcgccaaaatgacgtctcgcactttgacatctttacgaatagcgccgcaggaaccgactcttattagattttgcacatcgtagctttgaattaattcattcacataaattgaaatagacggaacgcccattcccgtgccttgtactgagatttttttacctttatatgtacccgtaaatccatacatgcctctgacttcattgtagcattctacattttcaagatacgtttctgcaataaattttgctctgagaggatctcccggcaaaagcacagtatccgcaatttgtcctttttcagcacctatatgtacactcatctcatatcctcctgtaaatctaaattatcatccagcccgtccattttacaacgaatgtcatgatgaaacaaacttcagcattgattataaaggaatatgtcgaaaaaagaaatgttcgaggatctgttaggcacttcctcagaaaaacggataatcggggtgttaatttgaaaacctaaccgcaggaaggaggggtaggacatgggtaaaaaacatcgtaaccggatcaccggccaaaaaaagaacaatcatatacctgaaaaagatatcattgcagctgaagaagcacacgggaaagaatattctgctgccaaacgcaagccttaaaactgcagaaaactgcgggtttccgcagttttcttttcattatgtcgtttgtacaatcagacgattgattttcctccagccggcgggaagcagttgataatatgttttcccttttctgccctcgtcaatcaggatcacgtcccctgtggccatgaatcttgcatcataatcactcggaacagtgtcgaatacattaaacaaagagaatgctcttttcagcacgtcttgatgatcgctcccgttcagttcagttcgatagacggctctgtagccctttttttcgccaaaccggggtgtctgaaatattgtcacgtcataggaacaagacttctttttaaacacggataacatcatcaagatcccctccctcttatttctttaacatattggcgtttttgctgtgttttcctctctctatttttgtcgaaaccgcttaatcttttcgtcaaaaccttttactaggaaaaacagaagcaagccgaggctaaagccgcctaacacatccgtcacaaaatgaacccccagatacactctgcttatgccgactaaaacagcaattacaccggctatgatatataccatttttttatgcttggacaaaaacgggaggtgtttcactaaaaagtaagcaataacaggatagacacaagcagcattcatggaatggccgctcggaaaactgaaggatgattcatgaaccagcggtgcaaaatcaggcctcactctttcgatccattcttttaagactttgtttaacagccgatctgtgccgaatactaagagcatcaacaggccgtcccatgtttttctgtagaaaaacatgcctgctccaatgatgacaattagagggagcagaaaagaagaagcaccaagatgcgtgatccccgtcatgacttcattaagccatggctgacggatcaaaacagctgccttgcttattgcttcatctgcagattgaacagcatttgtatgaatggccgcagctagaatgagaaagaaaagaaacaagctaacgggcttgtacaatttaaccacctcaattttcacagaagtcatagaacacgaataataaaaccggagctgaccgctccggttttaagcctcactcatcttcatccagctcttcatctatcatacatttttctatcaaataatcaaaggtaatatcagcgatttcaaacagctcatcctcactcggtatgtagccccgtcttgcaagctctctgtaaaaaaattcagcgatttcttccgtatcaatcacaagatctatttctttcatctccgtaccgcctccttttttatgttttatgaaaaaacaggctgaattatacccggtgttctaaacaattctttcagtcatatattgaataaaaaacgagccatgggaggctgacgctatgattgctaaaatgatggaagcactggacggagaaagatttgatatcataatggaaaaaacgctcaaaggaatgacgcgtgtgatgatttggggctgtctgccatattttttatatgtcttgatccgtatgttcacaaactaactgaaatgctcttttaaactttccaaaacaaacatcatcatgtctttatattcttcatcctgaaacatttcgtacagtattttgtagtcattataaatatccagaagctcatcaacaattgacacagcaaggatgtgaagggtatcttgatcttcatcatcgccttcaaactgaagaagagcagacgatgcgatatcttcgccgatctcatggccagtttctccgacataatggacaaacaacagctgatgcacaaactggtccatttcatattttctaagcaccagcgtgagatcctcttcctccgtttcaagccactctccatcctttaaacgggtcagttcataaatgatatcttcccagccatcttctaaatatctccaaatttctgttctatggccgataatgcgaaagagttcttttccataatcttttacataaacaacgtccccaataaggaattcatactcaatatcaagcttctccatgtcgacaatgacaccctcataatctttataaagctgaatagatgattcaaagtataaaacttcgttatgattgacttcataaagatagtgtttatcaatttggtgcacttttgtgatggtgccgactgttccatacataatgacgactacgatatcccctacttggaatttcggtttattttgcttcatggtgtctccccctcgccgcaacatttctcatacgctatcgtatgccgggtgaagccaattcgcatgggcatgaaaaccaaaggaaatatccaattatggtatgggggacataaaaaaatccgcagtgatctgcggatgaaacagctattatctgccgtgcacttcagactcgtattgatcccaagcttcatcaaacgtcgccatcgtgtgaaggtaatcagcattcagctccaaatatgaactgatttcatgataatcggtagatgtttttggaaagctgtgatcctcatacgcctgattggcaaattcactgatgctgtccttcggcttagggtgcctgtatttcaataaatagtgataaaaggatttcatgggtttcccctcctggtgtctgtcttttgttgttctattatacagttcaagtgtaaaattacaacaaaagaatactgaaacatgactcaggagaagtcaaaatagttgcgtttcaaaattctttctgtctccatgagctgctgatatgtcaggctttcaggcagtttttttgtttgaattaaaagcagctgatcctcaatctcctttaccgtgttttcctcttgataggtcataccgcaggaagaacataccatggcaggggtgtctgtcagttctatagcccttgttccatcagggagctcccagtacaccgtgttcctgccgggcaccgcttcaagctcgccgcaccattcgcatgttttcatgaagaatcccctccgcattcagtctctttctgttttttctgctgcgccaaaaatttcttttctttgagctgatctcttttctcacgccgattttttaatgtttcatgctccggatttgcgatgtatgcctctctccttttgattctgtctacattttcaggtgtaaacgaaacctctttgtcagcaaaaatggcactcagcccgatcggctccttttcgtcagcggtttcagggaaaacggactcaaaataggcgtctgcctgattggggatataattctctggttccggatatgacgtaatcacaccttcaaaatttcttaagatcactttgtcaggactttgtgacaggacatagtttggctgcagggcgattttaccgccgccgcctggtgcgtcaacgacaaaggtaggaaccgcatagcctgaggtatgacctctcagcccttcaatgatctccaaacctttggaaacaggagctctgaaatgcccgattccctctgacagatcacattggtaaatataataaggacggactctgatttttaccaagtcatgcatgagctttttcataattggaaccgaatcattaatacctgctaatacgacagcctgatttccgaccggcactcccgcgttcaccagcttttcacatgcctcaacggattcttctgtcatttcgatgcttgtgttaaaatgggtgttcagccagaccggatgatattttttcaatatctcgcacagatgatcggtaatgcgctgcggaaagacgacgggcgctcttgttccgattctgatgacttccagatgtggaatgctgcgcagctcttttaaaatatattctaaaatttggtcgttgatgagcagcccatcaccgcctgaaattaaacaatctcggatttcaggtgtttcccggatataagcaattgcagcatcaagctgttttttggggactcccattccgatttgtccggaaaagcgccttcttgtgcagtagcggcagtacatggaacattgattcgtgacaagaaacagcacacggtcgggatagcggtgtgtcagaccgggtaccggtgaatcttcatcctcatgaagcgggtcttccagatcgtattttgttttgtgcatttcttcagaaagcggcacagactgcatgcgtaccgggcatctcggattgtcggggtccattaaagaagcatagtaaggtgtaatatttaaggggatcgttttagtagaaattctgacgccttcctcttcatcctcagtcagattgatgactttctttaaatcatctaacgttcttacagtatgtgtcagctgccaaagccaatcgttccatttctcttccggaacgtccttccataactcgatctccttccaatgccgtttcggtttataccatttgtttttcaaacgaattcctcctcgcgcatattttgacttacagttgcttgcaccaaatattcatgttttcaaggccttcggctataaagcaattattgatcagccttccgccattttgataacctgaatggtacaacacagcattcatcccaaaagacgaagcacgggcgagagaaaatacatgaaagatatcctttccagccatttctttttctaacgcctcgattaaaaagcttgttaacgaatggccgcgatattccggcagcacagcgcaatcggttatttctgcatgcccaagctctggattgatttctgcgcttgctgagctgatcaggcggtcatgatcaagcatgatataatacaccgtatttgcattcatcgtcttttcaatataagcggggtcaaataccggtgttgggtacgtgcggaatacttttttatacagcatcgatagctggtacatgtcgtttgtttctgcttttctcatcgtaaaaacgggtgtactgtcgttgcgaagacggggcgctgtgcgatatatggcttcgatgatctcctgttcctctgtataagaatctgtttgtctccggctttctgaaaggtaacgtaccatgacacaagccgaatagccgagataatagccctttagatagccctccggcgcaaataattgtttggcaaggatcggctcatcatgctgcttcgcatagacaatgattttttctgcattctcttcttttgccgctgccaagatatccggcagggccttctcaatagctccgtcataacggaccactctgattcgtttattaaagccgtcatggtccaaaactgctgtgacaccgctactctttattgacttgagcatccgcatcctccccatctgtatgaagcccgcaccaatccatgacaaaaagtgcaataattttagcagattctatcatggcttcaacctcaatgtattcattggcctgatgagccgtttttgtttcccccggcccgaaaacgatcactggtgtatctcctgcatggtacaaaagccctccatccgttccccacggggaagcctcaataatcggctctgtctgtttcattttttgataggctgattgcagcacagaaattaaagggtgatcatcaggtaaatcattcggcagccattgagcgccaaaccattcgacttgtacgggatggcgtttaaaccattcgtcatggtattctaaatccttcagccagttttccaattcaagttttacagcttctggtttctcatggggagcaattccgcatctcccttctataacgacacggtctgcaactgaagatggccaggcaccgcccgagatcgtgccgatattcaccggtaccggtattgggatattgtcatacagcggatctgaaattctcgcattgcggactttctccagctcttgtatcgctgtgataacgtgcatgcttttttcaatcgcgcttaccccttcatagcgtgtgcccccatgtgcggctaatcccttcacagtgatccgaaaccacatcgaaccctgctgcttaataaatagtttcatattcgtcggttcaggaatcaacgccccgtcagcacgatagcctctcatgatggcggacagtgtaccggcgccgccgcactcttcatctacaacactctgaaacaatacatctcccttcaatttgacatcgcaagcgtgcagggcttctaaagcaaaaagaagggctgtattgcctcccttcatatccgttgagccgcggccgtatattttaccgttttcttcgacagcttgatacggttcatacttccaatcctttacgcttccttcaggcacaacatcgatatggccgttcaaaatcagggacctgcctccgccggctcccgtttttttagccacgatattcgggctctcatgaaaatcggatcggttagatttaaagtagggatgctgttttaattgctttatacttggctcccatacatcaatgtccatatgaaattgccgcagcttttcaagcacaacagcttgggcgttaaactctgaccccaatgtgcttttttccccaatcagccttttgagaagacgaatggctttggccgaatgctgatcaagccacccgattacttttctttcaatgtcttgcatcctcattccccctcttaagaaaaaggcatatctattttgatttcagcatctgtcagcctcgtcacctcatcgattgtcgagccattcatcagctcttttaaaatgaagtgatggctatcgacctcaagaaccgctttttcggtaataatcaaatctacacagcctgcagcagttaatggcagcgtgcatctttctgttaatttaggccttcccttttgatctgtatgactcatgacgacaaccacttttttcgctttttgggcaagctccatcgccccgcccataccaggcaccttttttcccggaacaagccaatttgccaaatctcctgattggctcacctgcagggcgcctaaaatcgtaatgtcaattttgccttttctgatcatcgcaaaagacatggttgtatcaaaataagaagccccttttacagcgcggacaggatagcccgcggcgttgcataaatgcgcatcctcttctcccttttcgggactttctccaatgccaaggacaccgttttccgcttgaaacatgacctgcatgtcaggcttcaaaaagttcggtaccaaggatgggataccgataccgagattcacaatcatgccctgcttaatttcagtagcagcccgttttgcaatctgttctctttctgctactcccaagcccatttccacttcactccctcgcttcttacaactccctcaacaaaaacccccggtgtgacaatcatttcttcagaaatctcacctatcggaacgatacgctcagcttcggcaaaggttctcctggcggccattgccataagcggattcatattgcgcgcggttttgtcatacgttagattgccgaattcatctgcaatgtaagcattgatgaaagcaaaatcagccgtcagcgcctcttcaatcaagtatcgttttcccgccactgttacgatgtcctttttttcgcaaaccatttgattatcaatgcccacgtcggttaaaataccgccaagccccgctccgccggcgcgaatccgttccgcaagcgttccctgaggtgaaaattgaacctctaacgtcccctctgtcatctgttttccggctacaggattggaaccgatatgcgaggcgatcagggttttgacccgttgattaacaataagcgggccgatccctatatccgggaaaccggcgtcattgcagatcacagttaaatccgttacaccgctgtccaatatcgcttcaatcaatgaaggaggcgacccgactcccccaaaaccgccaaacatcagaaccgatccatcccgaacatctgcaattgctgtgtcaatgctgattgctttttgaaatgacgccatttaatgtcaatccttttttaagtttttttcgaccgctgcaactgtttctgaaaaaatagagataagctcttccatttcaccgtctgaaatggtaaaaggaggagcaataatgacagcatctccttctccactgtctattccagctttggaaggataaacaatcagcccgcgttttttcgcctcgctgacaataatctgagttatcgtctgctcttgcggaaacactttcttcgttttttggtctgccacaaattcaacgcctaatagcagtccttttccgcgcacatcacctataatgccgctttgagatgccgcctcatcaagctttttcttcagcacagcgccctttttttctgattgtttgatcaagccgtgctttaacacatatcgcaaaacttcaagagcagctttggctgaatagggatgtgcactatatgtgtgaccgctcataatcacacctgacccttgttttatcgtttcaataatagaatcagatacgacggcagcagcaataggcgcataaccggcaccgagtcccttccccagtacagcaatatcaggtacggtgtcccaatgctctgtcgcgagcatccttcctgttctcccaagccccgtcatcacttcatctgcaataaaaagcacatcgtgtgtgcggcatacctcacttaatctctcataatatcccggaggcggagtaatcgctgctcctgcagcaccaataataggctcagccacaaagccggcgatgaattggcttccgattcttttgatcatagtgtccagttcatcagctgcagtctgaacaaagtcttcttctgtctcgtgattcagccgataaatatgtggagctgagatagctggataccgttcaatgagatgggtgaaccggtatctcctttcataaaaaccagataatgaaagcgctcccaaagttattccgtggtaactgctccatcgagacaaaaagatggatttttgtgtttgctttttttcctgccaatactgaatggcgattttcatagctgtttctatcgcttctgatccgctgttgacaaaaaaagaccaattcacatctccgggcagctcctgtgccaagagcgcggctaattgctcggcgggctcactcgtaaactgtgagcggtaagcaaaagacacctgatcaagctgttctttcagcttctcagtcacatcacgaactccgtggccgatattacatgtcaccgctcctgacgagccgtcgagatatttttttccggtctgatcataaacatatgaacccttcgcataactgacaaccggataggccgagctaagctctggcttaatcaaataactgctcatgctcccacctcaaaaccccttttaccatattgtatgagtgtccaaatggcggcatgacgttccccgcaaaaactttttcacataaaaagagccttcctaatagggaaggctcttttggaatttcagcatctagcaaataaaagcggctccaacaataattaataaaatgaacaagacaacaattaacacaaatgtatttgtcccgcagccaaatccgtaaccgtacccagagtatccatacatgctgttttcatcctttcttatcacgatatacggcattttatgcgggccaagtcccaaatggtttgtgcaaacgcctatttcatgtaaggaaataatgaaatacagtatgcacccgctcatattttttaaacgtcagcttttcgtaaaactgagttgcaccgtcagtgcttgcagcaactaagtaggctgcttccattcctagtgatttggcgatggacagcatttctttcactaagatactgccgtagcccttcctttgaaactgatctaaaattgccacttcttcgattttagccgttttctcttgatgatcgataaacagctcgccgcacccaatgggaactttctgtgcctggtcgctgtaacaaacaacaagaatgattatacctgcttcatagaaaggatattttctttttaatttttgttcagcgattgcttctccaatataaatggaatcgtaaattttcataatagaagatccgtcgctaagacttttcgccgtcccccatgcggttaaaggatgtcccatctgccccttccagtcactaagcttcatgtcatatagtagctcatcctcgacgacaaaaccgctttttacaagcgactgcttcaaaccgagcggaaaaacatgctgcggcgacgcttttaaatggagataattcgcatcaagcagctttggtacggagggtaaaaagttaagtaaccgctccaatggaaacgtatcatggagctgaacaaagttatgagaaaaaatttgcggaagctgcggatctctgtatacgctgtaatgatcaaacgatgccgattcagacgttaacaatatatattgatgttccgtttttgaataatgtcctgtcatgaacgtctcctttttatgacctatacctttactctgttgcaatattcaatttctttataatctcatcgtacaccggataaaacggctttccaattggaaattgctgaatatttcggaaagaagcggagattggcttctgatgtaaaaaaaacttccttgttacttgttcactaatcgggtgaaagacgccgtttagaaacaaaaacggctcgcgttcgatgaaaaacagacgtcggccaggcggatttttgatcaattcagatcgtttccacgtaatcggcggcccttccggaagcgcctccatttcttcttttccaattgtcactatgtcttttctttgaaattgataaaattgaaacgcatactggtccacaattcgccttttttttccggcttcgatataaaatattgcaggatggtcagcttcctttactaaaatataattcggaatgtttaaaattttgccaatcctatattggaataaatatgggtctggaacagcgacagtccgatttagatacaaaaaaccccacttttctccaacaggatgccttacaccctgatcaaaaaaatacacattttgatctgaaccttttacaaaagagccgtcaatcaaatcggcgggcagaaaccgatatgcattttgaaatgaatctggggttttataggttgtgtctaatacttcatttatcggcagaaatggggtaaagttgttgagtctcgcccaaaaaattgcgtcgccatgattccaatgcttcatatcatcatcccagtagcctccaaatttatgatggatgagattaagtaacgaacggcgatgcataactgagcaatgatcaacttgaaaagcggcctgatcaagcactgcattggcatttctgtagaaatgtgagatttcctctcccctttcgtttacatgtacaactttttgttttgaatagaccgcctgcgcttcaggcttatgtgaaaactcttgcaccatacggctcagccgctcaggatgataaacagtgtcgtcagtaagataggaaatgtaatcgccgtctgcaaatgggagcgcactgttaattaatgtggcataacgggctgtttttaatcgatctgcaggatgcacgaaactgttatgatattgaatgcgccggtcatggagatacttgtgaatcaccgcagttgtttctgcattcgaatgatcatccatgataaaaagctcccaaagatcatgcgtttgctgtatcacgctttcgatcgctttttgcaaataatcgggtttgttgtaacttgttaaaataatagacactttctctcccatctataccgcctcccaccgtcaaacataaaaacggctccgcagcaagcagagcctctgtcatcatttaaaaagcaccccagcttacaacacttgagagtgaaacatgagctctcgtgttatttaacgggttttggaaaataaccaaatcagtcagaacttcttttacgatgacattttgaagtgtatctccgttgatcaaattgacttttgaaaccggtacgcccagctcttttgcaaaaacaagctggcgtctgaggtcagatggatttccttcagaagacgattgacgtatcagcagaatcagcaaaagcaaaataaaatgcagatcatcttggttttcttctcgatccacttgtttctctaaatccaaatcatccctctcccttatccttatctctgtttcacaatatgtgcgacttcgatttatggtataggctatgtccactccattaaaaaatcagcattttccttaaatagatgaaaaatagatcaggtacggcgttcgactcataccaaataacagccggaagaatatgaataacgtgagttcactatcgaataggaggtgtgtgtaatgagctctgaaaatgcacagttaaaaaaggatttaattaaagccgttttaagccctttatttccaactgcaacagaaggaggagaaaatatggatagtaatcttaaagccttgcttgatgctgccatcgatcaaaaagtagatgaaagtgaaacggttacggcagaatctattttagacccttctcttccggcaagatggatttttgccagaattacgccaggcacgacaatcagcattgtgactgattcaggtgacatgatcggaccggttgttttcgttgctttcgatcaggttcacgggatcgtatttgtaacacaggaaagctccgtcactccggcaggccaagctacaacattaattgatgtagacaaagtagaaagcgttacgttcttttcataacatccgatgaaagtcttgtatatccagtcgggatacggaggaatatacagttattttgatcgctgggctgaagaatgttttcagaacactcatacagagtatatgattgcagataaacctgaagcagaatctttgatgaagatcgaagcgtttcagccggacttcacacttatgatggttggagaccgcgttcctcacgactggctgacctggttaaagggtaaggatatccccgtgtatgtttggctgaccgaagacccattttatatggatatcagccttcaggtaattaagcttgctgacgccatattaacgatagaacaaaatgcagctctctactatcaagagctcggctaccagaacgtctattatgttccgataccagttaaccatcggctgtttaaaaaaatgggcaccgaacattcctatcattcaaatctgttaatcatcggctatccttaccctaatcgggttcagcttacgaaagaagcggtccatctgccattcacggttcgggtaatcggcaaggaatggggaaaatatctgcctaaaaaagtgctcaaacagccgcatattgatgtcgtcagcacatgggttccacccgaacaggccgttcattattataatggggcagacatcgtaattaatgcgcatcgtccctatcattttgctttcaaccaaaatactatgcgcatcaaaaatgccagttttaataaccgaacgtttgatatcgctgcatgcgaagcatttcaattaacagatttacccgcggcgcatcctttttcatcctttatttcttatcacggcatgaacgactttaaggaaaaagccgctttctatatcaaccaccctgaagaacggcaaaaagctgcagcagccaattataaagagatcgtacccgcatttacgtttgatgagcttcctgcaaaactaaaagcgattcatctggcgctctcatgaaaaatcgttcattgctatgaacgatttttttattcatagaaaaaagcagctgcacaagctgctttctattctagccgtcagaacggtctttcagcttcctcggatttacctgtttatgaagatcaggcatttcgccgagatgctgtgcaatttgttcccacgatacaattttgaaattttgattgacggcttgtccgttatcgatattttcgccgtcctgcgccacaaaaatcccgtacggatattttgggccaagtccgaaaccgagaacatcaataccatccgtgtcactagtaccgtctatcttctcgccatctgtaatctcaaagttggctacatagcgatttttcccctgccgttcatacattgcatagctgttatttccttgacttgaagccatgagatatcctttgccatttggtgcataatagattgtcagtccttcaatatcagctgtcaaatgatctcctgtcgcacggtcaacaacctgcccctttgaccctccgccgggctcagcgttaaatttccagatggcttcatcttcctctgctatgtataggttcccatactcatcatccgcaacaaggccttcggtctgagaattcaacttaaattcacgcacctttttccctgttacataaccctttccaccatcaacaatttcatactgctcaaattccccttgtttgcctgtcactaatgcgtaaaatgctcctgttttctggctgtgatacaagctgaatccataaacctcagaaatattggtggaaataggatggttcggatctgtaatgcttttcaattttcctttatccccgtctattgcatatacttcaattgtattttttccttcggaccggttggatgcggcagcaatatcaattttttcgccgttcaatggaaaatcatagcgcagatcgacattattgagcttgccaaactcataagaatgaagctgttttccgtctaaatcatacacaacgagccctgacttcttatttgttgtaatcaacttgcttttttccgggtgtttttcatgaacccaaatggccgggtcatctgctgcatcatcgccagatgcgaccggatctgtctccgtgtgtgcagtcactttgaaatgatgttcctcattcacataatgagccgacaccgaggttgctgtcaggctaagcaataaacccgcggcagtgcttagcagcattgtttttgaaaccttcatttggtaccctcctcttttatcactaacactactattgtaaaatatatacaggtgattaccgtgaggaaaatgaacctttttttatagggtttctgactcataaacaacttattccccaaagaggtggtgagatgactttgccagatttacttttgcggagcgaaataaaaatatgttgaatatttagtacattgtttatttagttttgttttttcctagttacgtccgtttttccattttctattaaaaaagaacactttgtgacatgatcattcccctaaattttgttttattggttgctttcattaattcgattacaaagttgaacatatgatgcatggtagagaaacgagagttggaggataagccatgcctaaacagcaaacagcagaactaaaaccatttttccataacaaaacagttttagtcactggcggaacgggttcaatcgggagtcaaattgtcaaacgccttttgctgcttacacctaaacaggtgattgtattcagcaaagacgacagtaaacagtatgtcatgagccaaaagtatgcggaggataagcggctattatttgtacttggagatgtacgcgatcacagaagggtgaatcaggtgatgaaaggcgtcgatatcgtctttcacgcggctgcgctgaaacaggttccgacatgtgaggaccatccatttgaagcgatccagaccaatctcatcggcggacaaaatgtggtggaagctgccctttcacaccgagtgcagcatgtcattaatatcagtacagataaagctgtatctcctgtgaacacaatgggtgccaccaagctgttatctgaaaagctgtttcatcaagcaaaccgccacgtccaaaacaaaggaaccttgttttgttcggtccgctttggaaatgttctcggttccagaggttcggtcatccccatattatttgaacagatgatggagggtgaacccctgaccatcacagacaaaaacatgaccagatttttcatgtcaatagacgatgcagctacattgacattacaatcggctgctattacaaaaggcggagaaacctttattttcaaaatggaatcactgaaacttgaagaactgattcatgggtttgaagaatatgcatcgcagcacgggctcccgcggccggctgcagtagaagtgggcaagcgtccaggtgaaaagcttcacgaagaattaacatctccacatgaaattgaatcactgtatgaatggggcaacctttatgcgatccttccagagccggaaaaacatcctgactttcgcaaagtcaatctgcctgggtatcaatcagatcaagccccgctcattacgaaagaaagaattgctcagattattgaagaattgcatcaagagaaaaaggcataaaaacaagcctgtctatccattaggcaggcctgtttttaacactttatttattaaagagatgcagatagctttcgtatccttcttcttttagcttatgcttcggaacaaaccgcagcgctgctgaatttatgcagtaacgaagtccgtttggaccaggtccgtcattaaatacgtggccaagatgagaatcagcagttcggcttcttacttctgtgcgaatcatgccgtggctcgtgtccagtttttcttccacttcttcttcttcaatcggctttgtaaagcttggccagccgcagtgggaatcaaatttatccttggatgtaaacaatggcttgcctgacacaatgtctacatacaacccttcttccttatgatcccaatattcattttgaaatggcggctccgtgccgttattttgcgttacttcatattgcatgcgatttaatgactttattttttcttctttattgtacgccatttatttagccccccaatgctcgctgataaatcccgctcgtccggaacctgtccggtagcgctgataatgtgctggattctttttataaaaatgctgatggtagccttccgcttcatagaaaggttcagcttttaaaatgtccgttacaatcggatctttaaagatgccgctttccgccagacgttgcttggaagcttccgcaagctccttttgtttatcattatgataaaaaatggctgcgcgataggaactgccgcgatcagcaaactgccccccggcatctgtcggatcgatttgctgccaaaataattcaagcagtttttcataagggaatacatcaggattaaacgtgatttgaacggcttcacgatgtcccgtcgtttcactgcacacctcttcgtacgtagggttttcagtatggccgcctgtatacccggacaccactttttcaattcccggctgttcgtcaaaaggtttaaccatacaccaaaaacagcctcctgcaaatgtggcgatttcttttttttcagacatactggtgcctcctttgttaatacgtggtattattatattatagcatgtaaaaatagaatgaaaatgattctgcttttcaataaaatctataggttttaagcaatatgcttatgtaatggaggttcacaaatttgaaagtaagaacacagatgatgtacgatatggaaactttactccgtaaagtctttaaacaaatacgcaatgaaatcaatgaaattttagataaagagctgtcgcggaatgaattcaccattcttcgaatccttagtgaacaagggcctaaaaaagtcactgaatttgcgcctattttagaggtatcggcaagccacattacggctgtgaccgatgcgctggtagaaaaggaatggattacgagaatcagatcgaaggaagacagacgcatcatccgcattcatatcactgaagcaggcgaaaaagtccttcagcactttaacgagaaaaaaacggaatatttctttaaacgctttgactgctacactgatgctgaacttgccacgttaatcgagctcttcagcaaacttgataaaaaacggtgaaaaaaagcacataccgatatataggtatgtgcttttcgcagtgcttcacttatttttcagtaaacagcttcattgctttccagcggccatatctataatacaaaaatgccgcgcagctgctaaataaaaaactcattccgattccaagcccgattcctttttgtccaagccaagctgaaaatagagctgtgaaaggatatctcaacacccaaaacgagattaaatttaataccagaacctgcagcatcgctcccgcggccctgacgattccgttcagcacaaaattaatcccaataaaagggtagaaaaacgcgatccacttcaaatattgttcaccaaatgcgaccgcatcaggctcactgataaataaccttatgagatatttaccaaatacccaaatcataaccgcaatcaccagcatgcaggaaataacagctatcacacccagccttgcaattgttcccactcttttttcgtttccgattccaatattttgccctgccatactattgacggccgtaccggcagccattgctggaagcgtgatgatgctatcaagccgctgcaccgcgccaaatcctgataccacgtgatccccgtatgagttaacaacactcataatcgccatcataccgcctgtaatcaccatcatctgcagacctgccggaatcccgagtttcaaaatcagcgcggactcttcccacttgggcattctcggaatcgagaatggcacaagcttgtgtttgatgacataaaacaacccatacaaaaacgcaatgccctgtgacaaaatcgttgaataagccgctcccgctattcccatgcggaacacagaaataaagagcggagcaagcactgtattcagtacaacagcaaacgcaataaaccggagaggtgtcttgctgtcgcccagcgcacgaagcacagtactgataaagttataaccaaacaaaaataaaatgccgataaattgaatctgtaaatacgtctcagcaagcggtatcattgactccggcgtttttagaagacgcagcaaaagctctgagagaaaaaaaccggccgcgccgaatccgatgcttaggcctgttaataaaacaacaaaagcgttaatatacgacgccattccttttacatcatcttttcctttttgctgagataaaatggttaaagtcgcattgttaaggcccaaaataaaagacagcacggtcaaaacaatcgtgcttgataccgcggctgccccaagggcctttgcccccagtaaattgccgatccacaagctgtctataaattgaaaggaaacctgcaatgcgtttccaagcataataggcattgaaaacagtacaagctgtttcagcacgttcccctgtgtaaaatcgtatgctttcatcttttctccttgtgttctcaaattttcttcggaccgcacgaaaaaagagacgttgtttcatgtctcttttttcatgacttatcggttttttttcggtctcgcataccgaatgtaaacaccatcacacttaggaacaaggcacaataggaaacattcaaatacatttgatccatgtcttcagcagccagatgatgataagcaagccagccgaagtacagggaaaatgtaaaggataataaactgaaatactggtaaatctttttcattttcagtcacctctattgtttaggatggtaataggaaaactcaatttcatctttttctaaatttatcttatccgctttgacatacattccattcgttaaaggcatttctgacaaacgcacttcaatgcttttatctccggggtgaacatggacaaatgacggcaattcataaaagctgtccatataatttaacacaaagctaattggtatactcaatttccctaacgaaaatttcgtgacattcagctctacatcaccgttttttttcacggtcggctcaaaagcgataaacgcatcaatagacgtggaaaatgccttgattttccctgcgacatgaacatcatcatcaatctctactttataatcaagcttatttgatgctttgtcgtttaaatatgagttaacaaacgcagctaatgattcttttgtgcttgtcacttgaaatccatactcgctctcagatgaatccttcacctgagcctgttcccccgggagcaaaacaagtgccacaaaaccggcggcgaggataaaattaattgcaagcaatataaaaaacagtcgcttccacttattcatgctgtcaccctactctttcggtaatccttcttttttaatggcttgatagacgcgctttgcgataagagaataacccgtaccattaggatgaaaatcatcttcctcagaaattcggctgctgtcccttttttgattgaacaaatcttcgatatgaacgatttttgcatgtttatcttttttcagctctttttcagcaatatggttccaatccgtgacgacaccatttatttcatttagttctgataatgtaaacgtaaacggattgtacatactgacataaatcagctcagcgtgatcattcagctcgcgaatttcagaaatgattttttcaaagcgcttttcgtacggtttttccgcttcctgaaacggttcaacggttaattgcagaaagttttggcgaaggattttcatcaaatcattaccgccaattgtaaaaaagacataatctgcgtcctttatgcctttttgaacctttttatcttttagtttttctaataaatcatccgaacggttcccttttacagcataatttttcacgtcgaccgttttgacttgtttatctgaccggatagaatccgccaccttgccgacatatccctttccttcgggatctccgactccttctgtcagcgaatctccgacagccgctatgacaatgtgttcttttgttttcgtttcatgggctttttgttttccctcagatgatgtacgtatgctcgtacacgcagtaagaagcaaaatcaaactggccatgattgaaaaaatgcgcagcttcaatcttgttgctccttcccattctactagtggaaagtgtatcatgttttagaagatttgcaaatgcctagtctcttagcttacttgagtgtactggctgactttacatcggaaatgatatcatcgtacggtgtattctccactccattgtaatctttcagcaccttaccgtccggacctaccaaataaaaagaagattgatgaatcacttggtcctctccctccggcttctttacgatcgctttaaagctcttaagtgcgaactcctcaatctcactctggctgtatccagtgagaaaatcccagttatcaaaagataatggataatttgcggcaaatttcttcagctgtttcggcttatcgttttctgggtcaacactaaatgatatgatgcggacatctatattttcggctttcaattttttttgcagatcggtcatatgagcggtcattggcggacatacagtttcacaattggtaaaaataaaatccgccagccatacttttccttttaagctctctaaagaaacgttcttgccgtcttggttttgaaatgtaaaaggctccacctcgtaattgagcggatttttaatctgctgtcctccgcatgcacacaaaaacagaaaaatcagcccagccgttaaccccttgataaccttcatgacatccatcctttccagccagcataaaaacgctttctaaaaccgtccttactgtcccatgtttgtattcgatactgagcaaaaaaaatcctgcatgcctccccattaacgattacaaaggagggcatgcaggtaaaaaacggcatgttacgcgttgtgctttaacacctcttgatgaaatacagcctgataatctgcccacttcatccggcgcttcatataatgtcggaaagaatacacttttgccctgctatttgatgaaaacacttcttttaagtagaattgcaaatggtgatgtaacataaagaaatagtgctcatcttcctttaatacaggtatttctgtcactttcacctgaatcccgtcaccgcgtttgaactctaggcttttgagtaacaagctatcaatcctcttttttgtttttcttctattatatatgatgccagccgggctgtctgtcattttgcgcggttgtgtaaaaaaattagattagcaaatggaacaagtcctcatccttgttcacctctacataatgaaacggttttttgttcatccgttcaatcagcggcccataatcggctttgttctgcagctcgatgccgacaagagcaggtccgttgcttttattatttttcttcgtatattcaaaccttgtaatgtcatcattcggcccgaggacttcgtcaagaaattcgcggagcgctcccgctctttgcggaaagttgacgataaaataatgttgaagaccttcaaaaatcaaggaacgctccttcatttcctgcattcttccgatatcgttattgcccccgcttaccacacacaccacgtttttccctttaatttcatccttgtacaaatcaagcgctgcgacagaaagagctccagccggttcagcaacaaccgcacattcgttatataattcaagaatggatgtacatacttttccttcaggcacgaggagaatgtcatcaacgacagtttccagcgtccggaaggtttcctcgccaatttttttaacagccgcaccatctacaaacttatcaattttatcaagtgtgacgacatgcccagctttgtttgattcaaagtaggatgccgctcccgccggctcaacagcaattacctttgtatcaggagacacgtttttcaaatatgtacctaccccagagagaaggccgccgcctccgacacttgcaaaaagaaaatgcggttctgtatcaatgtcgtttaaaatctcgactgcgagcgttccctgtccggccatcacatccggatcatcgaatggatggataaacgtccgagattccgcctcacagcattcagcagcgcttttatacgcgtcgtcaaacgtatcgcctgtcaaaataatatcgataaatccttttccgaatagttcaacttgagatactttttgtctcggtgtagtagacggcataaaaattttcccgtgaatgccaagatgtttacacgaaaatgccacaccttgagcgtggtttccggcacttgcacacacaactccgttctctgtctgctcgctggaaagctgtttcattttatgataagcccctctgagcttaaaagatctgacaacttgcaagtcttcgcgttttaaatagatattgcattcatatctctcagaaagtctgtcattcctctgcaaaggtgtgtgaatgacaacgtcctttacgttttggtgagccttcaaaatgtctttcacttggatgagagagttttctttaagcaacggtttcatgtacagattcctttcttgttttaaatccctatttaatatgccattataacatgaatattcaaaaaataagacaattatttttatttaataattaaaaaaatacagactatgtccaccacatcttgtggtaacttctgttcaaccattatcctgcagagccaagaaaaaagatgatcgtaaaataaagggtgttttcaaccaaaaggcatgatataatgaaaccaattagaaccaaaaggagccaattgatgaatagtgcaccaaaactcaatacatttcaacatctaatcggagaacatcaaactttcctggaagcgaagcgaatcgccaagcagttctcgttatcggagcttcctgtcttaataacaggaaaaatcggaacaggcaaaaatcacttcgcacatgccatacacttggaatcttcgagaagcaatgaaccgtttataagcgtcaattgcagcacccattcggaagaaacccttattcatgagctttttggccctaacggaaacacaggtgtttttcaaaaagcggtacgaggaaccctttttcttgatgatgtatggcgcatgcctgcttctgtacaagctcagctgttaaaagcgcttgattcagacacggagaaaccgcgaatgatctgtgcttctgcagaccgatctgtggaacatacattcaggcaagacttattctacagactgaacattttaacgctcacactgcccgaattatcggaacgaaaaagcgatattccgcttttgacacagcattttctctcaaattccggtcagcaattgttaatcgatccctccgtttttcccgtgcttgagaaacatgcatttgaaggcaatgtcagggaattaaaaaacgctgcagattatatggcggcagtatcaagcggaggaacgatccagccatatgacctgccgccatatattagaggcgcgatagacggaaaaacgtcgaagaaaaaagcgaagctgctgactttaatggaaaaagctgagtttttgtttattttggaaacaataaaagtattgaacgaaaaaggagaacctgccagcagacggatcatttctgaacacagcaaaaatacccaaacctcgttaactcctcagcaggtcagaagccgtctcgactatttggagaaaaaagattatgtcaccaaaagccgcggacgcgcaggcacaaaaattacctttgagggcttgagctttatagagacgttaaaaaatcaaatgatctagcgatcgaaaggagaatgcacttgtttacaatcaaagaagagatcgccaatgcgattacacacggcatcggtgtcctcttatccatcccagcattagtgtttctaatcatatttgcggctaattacgggtctgcatgggacattgtcagctttacaatattcggtgtctctatgctgctgttatatttgagctccaccctgcttcacagcatcacacataaaaaaacgaaggacattttggagattattgatcatagcgcgatttacgtactcatcgccggaacctacacgccttttttgcttgggccgctgaaaggcacactcggctttaccctgttggttatcgtatggtcacttgccctaggcggaatcgtttttaaaattttctttgtgaaacggtttatcctattgtcaaccttcgtgtatttagtcatggggtggctgatgattattgcaggtaaacctttatatgcttcactgagcggagcgggtttcagcctcctttttctcggcggcattttatactctgtcggaaccatcttttacatttggaaaaagatccccttccaccacgccatttggcacagctttgtattgggcgggagcgctgctatgtttttctgcgtgctcttctattgtgtaaaggtgccgttcctttcgtaacagtaacagaaaagcgcagtcttcacgactgcgcttttttttatgcacgtaattgtttttcattggcaggtatataagcttttgaaaaggacaattcaatgtctgccggttttaagcgtttaaaaaacgagcccttttgcatgttatctgttcctttcgtttccaccatcaccaacggaagatgatagcgggccgcaagttctacaggatcaatagaaccatctagtgaaagaatcaggctttgtcccttttccagctgttttgtcacatcttcatataccttttctgaatccccgtctgaaatcacatccatccgatccagccattgcccgataaaaggcaagcggaacacttttgggttggcgataaagccggccggttcctcaatatatccagcaattaaggccagttcagccaaacgcaaacggggatgcacatacaaaacaggaccgtgtggtattggctctggctgatggatcgtcacaactgaaccggagatgccgatacagccttccaaaaacgcctttggctgttcgtacacaagagtcatctgttttttgtatgacagacggggatcgagcattgtttgattaaataattgtttcatattttttaacagcatatacacaatataaaccactagaaggctgtagcgaaccaattaaaatcctcccgctttagaagaattctttttttcatacattagaaattcgtaatcatacgggtttttttcgtctttggtcccctgctcagaagaaaccaacttccaattggattcatcaaattcagggaagtgacggtcaccctcaaactcgtgatgaattttcgtcatatacagtctgtccgcataagggaaaaggtccgtatagagctgagcccctccgatcacaaagcattcttcagggcctgaacaaatgtccagtacatcctttaatgaaccgacaaccgtgcatcccggaaattctgaagccggcgctgaggtaacgacaatatttttccgatttggaagcggacgtccgatcgattcaaatgtttttcggcccataatgattgaatggcccgatgttactttcttaaagtatgcaagatcattgggcaaatgccacggcaaatcattgtctttgccgataagcctgttggcatccatcgcaaaaatgaatgaaatcatacgcttaccgccccttttatatgaggatgcggatcataatcctcgatgataaagtcctcaaatgcaaagttaaaaatagaatcaacctttctggcgaaacgaagctgcggaagcggtctaacatctctttcaagctgcaaattgacttgttcaatatgattttgatagatatgaacatcaccaaatgtatggatgaactcgcccgattcaagcccagtcacatgagcaatcatcatggttagcagggcataagatgcaatattaaacggcacacctaagaaaacatcggcagagcgctgatacaactgacaggacagcttgccgtcagacacatagaattggaacaggcaatggcacggcggcaacgccattttatcaatttcaccaacattccaggcgctgacgattaagcgtctggagttcggatttgtcttaatatcttcaataagacgggaaatttgatcaatggtttctccatcagctccccgccaagaacgccattgggagccatatacaggtccaagttcaccgttttcatcagcccactcattccagattcgcactccgttttcctgcagatagcgtacattcgtatctccttttaagaaccacagcagttcatgcgcaattgatttaaagtggagttttttagtggtgagcatcggaaagccttcccgtaaattaaatctcatttgatatccgaaagtgctgattgttccggtccctgtccggtcttcctttttctcaccatgctctaaaacatgtctgcataaatccttatactgtttcatttttttcatcctttaaaagtagtcttctagtagtgtaacacaataaaaaatcatttctgaacccagaaatgatttttttatagtcagctgacaacaggcttttcatcctgttctttttcttcatcttgcagatcctgatgcgtatgtgcaattctgctcgccgctgctgcagcaagagctgccacaatatcatccaaaaaggtgtgaataccgtctggactttcatcaagttccttaataattccaatcttctctttatccaaataaccgaaattggtcaaaccgatcgacccgtacacattaacgattgaaagcggaataatttcatctatgccgtaaagcggttcatctgtttcaacaaggtgctgcagcggctcggggagaagcttctgttctgcaagctgatcgagtgcaaggcctgtcaaaacagcatgaataatttcacgtttgttcaggactttttctacattctccatgcaaacactgagcggcagatttggattgtatttttcctgaagtttttgaacaatccgtgcaatatcttctatcataacgccccgtttgttcagcatatcctttgttatatcgaccatttcattcattgtgtactttttcatgtctaatggcatctcctttaggcactcatccagttgggaggcgtgttgcggtcccaataaatgctcccaagctcatgatgtgattgaaatccatcttctgctgtatgataatgaaaattaaaccagtagccgtcatgaggcgggtggtctcttcgcacatggaatctgagaagatcttctccagttgtccgattgtaaacgttgaaaattttttccgttttgcccgctgaaggcatgcttgagatcacaacatcttggtacgcctcatcatcttgcaatgtcgctaaataatcactaatcacattttcgatttttggcaggatctctttccgatagtcatcctcaatgacaggagcgattctgctgccgaattttaaaaaggactgatcctcagcgctgtcaaggagctgttccttgtacgattgaaaaagcagttcaggattttgcctgtcatccgactcatcatcgtacaggtcatgctcatcataaaaagcggtgtaatcattctgctcaagactgctcggctgtccggaaggcttgtccgccataagggcagccggaggagatacgagcccgaacgttacaatggtaaataaaaccacaagggtctttctcatccacaatttcatgactgcttattcctctctattttattgtcatgtttctcttattttagcacatccaaaacatgcaagtcatgtactatatgaaactgatatgcaaattaggagattcgttgctatgcactttgtgtaaaaacgcttacaatattccatgaaaggaggctttccgcatgattgacgctctgtttgccacagtttcactcttaacattattatactttgtcgtcatggaggtcaccgattaacagaaagcccgtgatatgaatcacgggcttgtttgaatgacgccataatggaacagtgctgtttttcttttcatgacgttaaaaccaaactgttcaaaccgcggacttttccagtggtcttttagcacaacgctttttctggcgactcgtaccgcttcattgatacatccttcgtgtaaaactgaatcctctgccaaatcacgtaaaggcgcgatgccgtcagaggtctctacaggttcatgaaacattggatcgaaataaaccacatcaacagagttgtcaggaagctgtttgatgtattctaagcaatcaccattcttcacctggattcttctcatcgcagcttgaagctcttctatacccgtttcccatgaatgcagccccgtcctcactaaaacagacacaagatggtttttttcaatcccaacaacagaacccgtttcgcctactgccatacttgcgataatggcatctgaccccagcccgagtgtgcaatctaaaaacgtatccccttcagataatccggcagcccgaagcataggctcttgctctccctgtaagaagcgtttggctctaaacatcgctgtattcggatgaaaaaagaatttggcaccttgtttcgtatacagctcaaaccgctctttgccgaccacaagcaaatcacgttcagctgacctcagcaggtgttcaaccgtttgtttattccggccgcagtatggcatatttagctctttagaaagctgctttgcggtttttatggtgtgttcagacggtctatagcttgttgttatcatcttctatactcccaaaaagaaaatgcccggaaaacgggcatttagcagtgcgcatcgaaggcagcagtcagatttttcatgatttcttccatatcgtgtccttcaatttcatgacgcggaataaaatgtacgacttctttgcctttcaaaagagccattgatggtgaagaaggctcctggccagtaaaatactcacgcattttcgcagtagcttctttatcttggcccgcaaaaacagtcaccgtattgtcaggtgttttgtcattctggaggactgcctgtgtagccgcaggacgcgcaaggcctgccgcgcagccgcatacagagttaacgactacaagagttgtgccctctgccttttccataaagttttctacttcttctgctgttgttaactcttcaaaacctgctccagtcagctcgcggcgcatcggtaagacaagctggcgcatgtattcttcataagccattgacataaaaaaagccccctctagtatccttcatctgaagtaaaggatactatagagagggccggatttcaaatgttcacgccttaaaatatagaagtaagtgtccccagctgtctagattttcataataccgccggtgttggcacttgtcacaagtttagaataacgtgccaggtagccggttttcactttcggttcaaaacctttccagttcgcttttcgtttttcccactcttcttctggcacttgtacatccaagatacgtttttcaatatcaacgataatatggtctccgttttcaacaaaggcaagtggcccgccctcagcggcctcaggtgatacgtggccgattgagaggccacgggaggctccggaaaaacgtccgtccgtaatcaatgccacttttggtccgagtcccattccaacgatttgggatgttggcgccagcatttccggcatgccaggtccgccttttggcccttcgtatctgataatgacaacgtcgccttcttttacttttcggttgataatgccgtcaagcgcctcgtcctgagaatcgaatacgacagccggcccttcgtgtcttgtaatcccattctgtacgccgcctgttttaatgatagcgccgtccggagctagattaccgaataaaacagcaaggcctcccttttcagtgaatggttgatccagcgggtgaatgacgtcataatcctttacttcatgtccggcaatggtttctccaagagtttttcctgtaacagtcagcgcgtctaaatgaagcgctccttctttcttggaaagctcattcagagccgctgacacgccgcccgcttcatgaagatcttcaataaacacatccgatgcaggcgccagcttggccaagtgcggcacgcgctcagcgacttcgttaatgcgttctaaagagtattcaacgccggcttcgtttgcaagggcaagggtatgaagaacggtatttgtagaacctccgagcgccatatcgagtgcaaacgcgttatcaatcgcttttactgtaacgatatcacgcggtttgatatctttgcgaatcgtttccattaattgcgcagccgattttcttacaaactctttgcgttccggagatgtcgccagaatggttccattacccggcaaagcaagaccaagtgcttctgacagacagttcattgagttcgccgtaaacatgcctgagcaagatccgcacgttgggcatccgaactgctctagttcttgaagctcgttttcgttgattttccctgcttggtaggcgcctaccccttcgaatactgaggaaagggagatttttcgcccgtcacttgttcttcctgccgccatcggtccaccgctgacaaaaatcgtcggaatgttgatgcgcattgccgccataagcattcccggtgtgattttgtcgcagttcggaatacagaccattccgtcaaaccagtgtgcggatacaaccgtttccacagagtctgcgataatttcacggcttggcagcgaatatctcataccgatatgccccattgcgatgccatcatctaccccaatggtattaaattcaaacggcacgccccctgcttctctgattgcttcttttacgattttcccaaactcctgcaagtgaacatgaccgggaacgatatcaatgtatgaattacacaccgcaataaacggcttgccgaaatcctcttcttttactcctgctgcacgaagcaaactgcggtgcggagctctatcgattccttgtgtgatcatattactgcgtaattctgccatggtgatcctcctaaattctttcaattgtttgattggattttattttgaaaattttcagtttatttatgagctgtttttgcaaataagataaattcaggccgccctcaccttgttttgttctttcgtgtttttatatttatatagcttttctttcgatttgaaccctccaactattaatattgttacttactataaatagttttcggatatttttcaacaatattcgaaataatttttataaaaagtgaattcacataaaaaaggtgcatgatctgcaccttttttatttctattcgcctttttttctgctttccgtcatttgtttccaaacagaaccttttgcttcttctccatgctcaatacgttcaagcgccattttgacttgaaggctgacctcaaattcggggtcatcttcggcagcgcgcaaagcttcaattgcactatcatccccgacttcgtacaggaacatggccgcacgccagcgaacaagcttgctggagtcgcttaacgacttgatcatagcgggaatggcttgaggatcgccgatatcagacaggcagtctccggccgttcttctgactgatacagctttgtcctcaagtgctttatacaatagaggcagaacatcaggtgtttcaatcattcctaagtacacaacagcctgtcttctgatggacacctttggatcatccaatgccttctgtaaaaccgggatatcctcttctttcggatccatctgttccaagtgtgcataacgctttttccagtcctcatcatccagcatgtcaagcgttactttatacgctttgcgctgtacagcttgttttgcttcgccctttccttgagcggctgcttcagtcagtcgtttcagccgttcatcactgtatgccgcctgaagctcttctgtcacgtcatggccgatttcattaaagtcaccgaacctgacaccttgttctttccaagcccgctcaaacacaacatttgaagcttcagatctaagttttaagatcgcctgctgaaagcgttcaggtaagccgaagcgttcttcccgctccccatcggttaatttaacttgcataggaatgccgctgaacatctgcacaaaaacttttacctctccaaaagattcttgatcagaacgattttcttctgcgctttcagcactttccatcccaaatgcagtgcggacttgcggtaaaatgtctttccagtcgtatcttgcattccgttcaacagcaagaaaatctgcgacgtgatatacccctttaactccatctattttaaggatttccgctataacaggcggtgcgccttctgcttgctcaggtttatagttattgcttttgcccgccggaagctcttccgttaagatgactttcattgtattcgggcttggtgtaggttcaattgattttatcttcatgatcgtcctcctatagcatatctgtgacttattctatcatagtcgctccaagccttctattacgacgttttggcatcaatcccggatatttctttttctaattggcggacaaactgaagcataaaattgtgtctttcttctgccagttcccgtgcagtgtctgtattcatcatatctttcagccgcagcagcttatgaaaaaaatgagcgtaggcgctttgatcatctccataaaggctatgcccgtttgcgcccgcaaacatgaaagctctcgcaatgccgacagcaccaatcgcatcaagtctgtcagcatcctgtacggcttttccctcaattgagagcggctccttcgccagcttttccctgtctcgaaaggacatccttgttataatatgaatcaccctgtcagcattctcttttcctactccgaaaaaaacgagctggtcatatacttcgttcacagaaagcctgaccgtgtcaggcagcttcacatcaattaaatcatgaaccaaagccgcggtttcaacaatgaacaaatccgctttttccttttctccaatatacgctgcaagatctgctactcttgatacatgatgccagtcatgtccagagctttcgtcagtcaggatagattgaacccatgtcctgatttgctctgcctgcttcaattccttcacaaaaacaccctctttattgctctaatagcttcacgatagcgtcttccagctctttcggatttgtatttggtgaataacggccaacgatttctccatttctatccactataaatttcgtgaaattccacttgatcgccttagttcccagcatccctttcgcatgttctgtcaaatacacaaacagcgggtgggcatttttcccgtttacatccacttttgaaaacataggaaatgtaacaccgtaatttgtttcacaaaattcctgtatgtcagcctcttcaccaggctcttggttcatgaattgattgcaggggaaccctaagatctccagcccctcctgctgatatgtatcatataattcctgcagctgctttaattggggagtaaaaccgcacttacttgctgtattcacgatcatcagtacctttcccgcgaaaggctgaagtgtcatgtctttccctgttattgtacgtacctttatttgataaatagacatgtaagtccctcctatgtccttggtgctgattattttaccttttttaaatcgcaattcaaaatgtaaacatcatttaagaactcataagtaatttgacgatatgagcgtccgttcattatcaattcatatggctcattttttatcttatcattctataaaacattacaattccctctgacatcatggaaaatcattttactgtgaaaccaaaaggcgtgtcagtgcgttttatttaaagagttttctgttgtttcccctcaacacgcatagatagattgaaaattggcgtgaaaattcctataatgaagaaaattaaacggggaaataatggaggtggcacgttgcctattaatataccaacacacctgccggcaaaacaggtgcttgaaagtgaacatatatttgtaatggatgaaagcagagcatttcatcaggatatccggccgcaaaaaattattatattaaatttgatgccgaaaaaaatccaaacagagactcagcttctcagattgcttggaaattcgcctttacaggttcatttcacatttttaatcccaagcacacacacgccgaaaaatactgcgagagaacaccttgacgaattttacacgactttttccaatatccgtcacaagaggtttgacggcatgattatcaccggtgcgccgatcgagcatttggcgtttgaagaggtttcatattgggaagagctcaaggaaatcatggagtggagcaaaacaaatgtcacttcaaccttgcatatttgctggggtgctcaagcaggtttgtactaccattacggtgttgaaaaaattcaaatgccgaaaaaaatcttcggtgtgttcgaacataccgttctttcaaaacacgaaagattggtaagaggttttgacgagctatactacgtgccgcattcccggcatacagatataaatatggaacagcttcaagcagtgcccgatttaaacattcttaccgcatcaaaggaagccggggtttgcttaattgtgtcaaaagacgaaaaacaagtctttttgacagggcaccctgaatatgatacaaatacgcttcttcaagagtatgaaagagatttggaacgaaacctttctactgtcgaggagcctaaacattattttgcaaaaggcagcaacgagccagtgaatcgctggaaagcgcatgccacattattgtttatgaattggctgaattattacgtttaccaagaaactccttatgaatgggactaatttttctttttttagtgatacgctgagcaaaaaatatgataaaatacatctgattcagtctgcgtataacaaaaatttaaaatactggaatccaaatcatttaaaattagcttaactttttcactgcattaataattcgattatgtatttgtgttatgtttatgtatagacaataactccttacgatgcatgaagcttgcttgttgttgattacattgaggtgaatttacttgaataccaataaaagagtattaattttgactgcaaattacggaaatggacatgtgcaggtagccaaaacactttatgaacaatgtgtacggctcggctttcagcatgtaacagtttctaatttgtaccaagagtcaaatccgattgtttcagaggtaactcaatacctttatttaaaaagcttctcaatcgggaaacagttttatcgtttgttttattacggagttgacaaaatctataataaacgtaaattcaatatttactttaaaatgggtaataaaagattgggcgaacttgtcgatgaacatcagcccgatattattattaatacatttccgatgatcgtcgtgccggaatacagacgccgaactggaagagtcattcctaccttcaacgttatgactgatttttgtcttcataaaatttgggttcacgaaaacgtggataaatattatgtggcaacagattacgtgaaggaaaaactgctggagatcggcactcatccaagcaatgtaaaaatcacaggaattccaatcaggccgcaatttgaagaatccatgccggttggcccgatatataaaaagtacaatctttcaccaaacaaaaaagtgcttctgatcatggcaggtgctcacggtgtattaaagaacgtaaaagagctgtgcgaaaaccttgtcaaggatgaccaagtgcaagtggttgtcgtgtgcgggaaaaatacggctttaaaagaatctttgagtgcgcttgaggcggaaaatggtgacaaattaaaagttctgggctatgtggagcgcattgatgagctatttcggatcacagattgcatgattaccaagcccggcggcattactttgacagaagccacagccattggagtgcctgtcattctgtacaaacccgtgcctggccaggaaaaagaaaatgcaaacttctttgaagaccgcggagctgccatcgttgtgaaccgtcatgaagagattctcgaatcagtcacttcccttcttgcagatgaagataccttgcatcgcatgaagaaaaacattaaggaccttcatttagcaaactcctctgaagtgattttagaggatatcctgaaggaatcagaaatgatgactgccaaacaaaaagccaaagtgctatcgtaatggcgtacttgagagcatacgaaaatcgtgtgctctttttatttatattcagccatcaataaaagcggttacatttttttatggaacttgcccttcttttgaaaaataagccgtttcgcaacttgacgggtgctcccagatggtgtatagttgaaccatcatttaacaatgaatcaaagttaaatgatgacaaaattttttttagcacatgggtgctacagtactaggaggaattaagcaatatgcaaaacggtaaagtaaaatggttcaacaacgaaaaaggattcggcttcattgaagttgaaggcggagacgatgtatttgttcacttcacagctatcgaaggagaaggatacaaatcattagaagaaggacaagaagtttcttttgaaattgtcgaaggtaatcgtggacctcaagcttctaatgttgtaaaactctaaactcaatacatgatgatgagatgacaaatagaggagaggcattcgcctctcctatttgattttcatctggatttcaatcgccaaaatgttttgtttgcacctctgttcaatctcttcaacatacttttccattgacggttttccttttttcgcgatatccgccagttcttctaaatcactgtatatttctataaatgttttgtgaaggatcaacttcaagtctttatcatccatagctgcgttccccttctctatcaagatacctcaaatagtaaaacagtcctatttattctggttcaatagttatatcggcttatttttattttcttttctattttggtacataaatttcaaaaaaactctgcaaaataatggcggaggtgtttttggtgacttcagaatttcataaagaggatcagactggctttacggataagcggcagctggaactagcggtggaaacagcgcagaaaacaacaggagctgcgacgagaggccaaagcaaaacattagttgactctgcataccaagccattgaggatgctagagaactgtcacaatctgaagagctggcagctctcgatgatcctgaatttgtaaagcagcaacagcagctgctagatgacagcgagcatcagctggatgaattcaaagaataaaaaccgcagcttctgcggtttttatttttagtgattggttaagacatctccgtattgtttcagcttttcaccaaccgtacatttattgatacaaaatgaatgcgcataagttttgccaaattctttgcgaaactgcttcttaataaaacagtccttgcaatattcatcgtgcagttctgtcagttctttaaagatcattttcttatccaatatcgtcatctccgttacggtctaatttcgtgtggctttctacgaattgatgggatagaatttttttagcgaggccgtcagcttcctgattgtcttttcgttgtattgtttcgtaggttggagtaagcttcagcgattcaaggagtgcttctattttgtcgagccattcattatgagatggatcataacaaggccagctgccgtcaagctgattcagcacaacaagcgagtcccctttgattgtaattgaatttctgcttgccccaagctctcttacttctcttattgcttcataaagcgctgcgtattcagcttcattattggttttcagccggaagcttttattttttctcaaacgatgccggattcctcccaatgaataatagatgacgatcccgagaccggccagttcgctctccttatcgaaactgccgtcaaaataaacagtaatgtcatcaggctcttgagcaagctcctctgtcagcttttccaattccttcagcgtccagctgccgcctttctcgtcttcgaactctagctctttcatgtatggaaaacggccaagttctctggcgagcatacgtgcctgctgtgctgtcagccagtcttcgctaaaaaatgagacggatcccgttccttttgcttctattttcaaatgcggtctgagcttcattacaatcaccttaccattcattagttgccgggcttatgctataatcaaaccaatcttaccccggaaaggaagctttttcatcttgtttaataattcgttttggatcttttttgcgatcattcattttatcattgttcttttattttataaaggatttggcaaaatgggactgtttgtttggatcggttttgcgacagtctgcgccaacctccaagtcgtcaaaacagttgaactgtttggcttaacagcgacactcgggaatgtgatgtatggcacaatcttttttgcgacagatgtgctgaatgaaaaatacggaccagctgaagccagaaaagcggtatggctcggattctcaacgctcctgacgctgacatttgtcatgcagggtgtgctgcttttcgaaccggcttccagcgacatatcacaaacagcgctggaaacgatcttcggattccttccgcgagttgcgttaggaagtctgcttgcctttatcttcagccaaacgctggatgtttatgtatattcggcaattagaaggatatttccttctgatcggcttttatggctcagaaacggcggcagtacagcagtcagccagctgtttgatacattcatattcactgcagtcgcctttctcggcatttatccggcaggcgtgtggcttcatatttttatttctacatatttgattaagtttgcggtatctttgatttcattgccttatgcttatgcagccaaaaaaatgatacctaaagatgaaaggagttcataatgcctacagaaatatacgtagacggcgcaagcgctggtaatcccgggccttcgggtattggcatttttatcaaacatgagggaacagcagaatccttctctattccaatcggagtgcatacaaatcaggaagcggaatttcttgcattaattgaagggatgaagctatgtgcaacgcgcgggtatcaatcggtttcctttcgaaccgattcagatattgtggaacgcgccactgagcttgaaatggttaaaaataaaacgtttcaaccgttcgtagaagaaatcacccgattaaaagcggcattccctctttttttcatcaaatggataccgggcaagcaaaaccaaaaagccgatcttctggcaaaagaagcgattcggctgaatgaaaagaattaaatcttgatcattggttcatcctaatggcgaggtgaactaacatgaaaaagaaagataaaggccggctgaccggcggtgttactccgcaaggcgacctggaaggcaatacacataatgaccctaaaacagagcttgaggagagagcaaaaaaaagcaatacaaaacgctagagaggatctaaacgatctctctagcgttcagcttttcaagcatacgctcaattcctttgatttggtggcggcgaagcatgtcagccgcctgctccatttgcaaagtaaataaagcgtctttcagtgtgcaggccagcggcactgagcaatgaatttccgcaagcttcctcgacatctccaaatcgcttaaaccttgctgaatttttccctgctgtccttttggaagaagagaaagattttccaataaacggtcaatcgtttcgtattcacgaatcagtttgtaggctgttttttctccaatccctttgactccgggatagttatcactggaatctcccataagcgctttaatatcaatcaaagccttcggcattacgcctgtttcttcataaaaagtctcttttgtatagactttataatttccgattcctttttgaagcaaagcaacgcttactttatccgttaacagctgaagtaaatctctgtcccctgttacgaccgtaatgtccgcttcattcgcaaataaatcggcaagagtaccgatacagtcatccgcttcatagccggcaaagccaatattcatgattccaagctctgcggctgcttcctttgccaaatcaaactgcggaatcagctccacaggcggcgcgctgcggttggccttataatcttggaacaagtcatttcggtacgttttgctccccatgtcccagcagcagacgacgtgtgtcggctggaatgtttccacagctgtaatcaaatgctttaaaaagccgttgacgccgttcgtcggcaccccgctgtcatttatcataaagttgcgatgtacggctgtggcaaaaaaggcccggaataaaagagccatgccgtcaaccagcaatagtttattattattcatcaaataactcccttttctttcattccttctattttatcataaagcagcccaaaaataaaaaacagtatctctttaattagagatactgtttggatatttatcaatcgttgtgtcttttgttgctggcgatcagcttttcagcttcgcgtcctgcgtaagagtcaaaatgggtttgaaatccgtttttctttttggcattgttattcgcctgtgcatttctgtttccgagctttgttctgcccaacatgaatccccccttacgtcggatgcatatagtatatgcttccggcaggaggttcactcgcgacaggatcatccagcttacatgcggcttacgtattctctgaccatttcttttgatacaagccgtcttgtcgggacgatgccttttttagcgagctgattcatttgctcggtaatttcattaattgcatctgtagtataaggctcatcgtttctgcatttagcaacagcttcttcaatcgccaattcacgcatattttcaagacgcataaatgctttgatatgctcgtgctgttttgatgaatgtgctgaaattgctttatgtacctctgacattaatcgttcatctcgcttttttctatttagtctatcatgacttgaaatacaagccaactgaattttacatttttattgtattgtctgaatttttccaggagatgcacgcctggtacgctatttcaatctctttcgcatgttccccttccgcatatcctcttaaatatgtctctttttgatccgttatttgcgcgattgctttttcacccatatcttcctgtaagcgtctgaggtgagctgtgtaatgagagatcaggctttcttcttcattttttatccatgcctctgtgattttcgtaagtttcatccgtacagcttcgataaaggccgattttcctttctgctcaaaaaactgcttcggtgatttgacctcttttagttcctgctcaaaagcacgttcttctatttccggttcaacttccttcaactgtatgccgttcgaatgctgatcacccgcataaacggaaaaataaccgtcctcgtttaatgttttttgaaattgatccagccattcttcattgatatgccgttcgatgaaaccgctcatgcgaacatcaagcgttttgatttcctgaatatattcaaattgatattcatgtaaggctgttgtcatcgccttactgacgttctttttccaatccccgttttgcagcccgggatgaaatgccgattttaataaatcatttgcaaaatatgataatcgctgtgtaatgtgatatagctgctctcttgtatctttttttactttttcaatgatggtttctgagttccgccgtttctcgatatcggccgctgtccgctcaaatgacagcataaggcgctgtttctgcgcttccttctcttctcgggactgatgctgggattggtgaagctgaaaaacagtttcgcatagtttgtctgcctccgaactgagctgcgctgctgacgctttttttacatccacttcgataaaccggtctaagtgttttcttactttcgggaactgattataaaatgactccggttttcccaccagttcctccttacttgatacggtaaagagctgcggctcataaaccccttcttttacaagctctgcgctgacataatcggtcactgtttcgagttctgttttatcttttgcaaggtctgcagcattaataataaaaaacattttatccatgctgagcgattctttcacaagtccaagctttcgcaaaaatgaacggtctccttttgaaaaagagtgctgataataagtcatataaaaaaatgcatcggcatctttgatatattggaatgccagttctgtatgccgtttattcatgctgctcgcgccgggtgtatcaacgatcgtaatccctttttcagtgagcgggcatgtataatagaccgttacctcttttacagcacaggccgttgtttcctctgctacatacggctttaattcagatagcggaatcgttaatttcttctgttcctgtatatactgctgatacttctcgtatgcaagcaggaaattgctgatcaatttcacgtgttcttcctgcagcctgttttttttgactgccttttcccacttctctgtgaaggaacggcctgccggttcctttggtattccggtgagctgcaaaatttcagccgttatgtcatcctctgtcttaaacactacatccgctgttttgtttaagttgccattgattggcattgtgatcttgttaattgtcgctgtggttggcgttggtgaggatggcagcactctttcgccgacaagcgcattggcaaatgatgatttccccgagctgaagcctccaaaaagagcgagtgtaaatttccgttcctcaagccttttcaccctttcacgaaacgctgaagtttgctttaacaacatgctgcattcgcttaaaaggtcagacaaagtgtaaaagcgtttgatttggtcttgaagcggcatttcttgttccattttgatttctgatttcggcatcggctgcgccgtcagctggcttcggccttgtttctgctctggagccgccactcttgttttcttcgatttaaaccattctgtgtctatatgcatggggcatgcggactcttcttcccaaatggcccacaggcgatcggttttctctcgggcattattctctaaacgcgcctgttcttgaagaaagacaagtttttctgattcttggacgagcctgtctttaattgtttgcacatctttggaaacacgctctttcaccatagcggagagcacctttatgatgtctgcggcttctcttttcgcctctttccggatgagctctgccaagtcttttgtatattgcaatacatattcagaggaaaaggctgcaccatgcttgaccgcgcgttcaatgatgcttatatcaagcggtgtgcgataggcctgaatcagcttttcactttcagcggtatagacatcaaataccttggcgagtttatgaagcgtgtctatcatatgccaatccgcttcgggctctgttcgttttgccacatcagagaaaaaagcattccgccttttatctctttcctgtgcagttttcgctttagaaaagaaaaagccggttttaaaggaaggctcttgtgattctaaaaatgcagccgccaattcacgcatttcaaaaggcgtcaggtttgcgttttttaaaatacgattgatttcttcctgcatcctcgtctctgcctcagtcgtttgtttttcggcctcattcaattgatcacgcagcgattggaccagtccaatttggatattaagctgttcagcgaaactcggagcgcctgtttcgtctttcttcagcatttccgtatgttcctttagcagattacggactttttgttcggttaaagcctgcatattgctttttgattgctgttctattcttcttaactcttctctcaggacccccatctgattgaacgggtggtccggttctgttactgacgtaaaatagagcgcttcctttgaaatcccttcattgcaaagcatctcctctacctgcgctttatagtctccaaatttcgtctccgtctcatcatggcggtcaatttgattgacgataaaatacacattcggaatgctttcttttattgatctgagaaactttacattttcctcagcgtgcacgtgattatagtgaacgacgtaaaacagcgcatccgcttggtgaagaatagaagcagccgatagaaaatgagcatcatctgttgaatctatccctggagtatcaatatacgcaaccccggaatcgatctcagtatacctgtcaaaaatttcgacgctttcaatctgttccccgtctttacaatattgctgcaccttgtctttctggtaagccccttccagctcagcacacgctccgtctgttgtatgaagccgaactcgcttttccccgtttctgatcacaacaaggttagcgcttgtcggaatcgggcttgtcggcaaaatattctccattaacaggcagttcagcagtgacgattttcccgctgaataatgcccggtaaacgcgatataaacctcttcatcagccgcttttttcatgaccgcagccagtttagcagccctttgttcatcttgattctcaataaattgcttataaatttccccagttttatgcaaaagctcttttctgttttgatctgtcataagtctgaacccctttgtgccgtttcaattgtgaacctttttcgaaagatctgaattcattcccttttcattttacacaagaataaaccaaatttctttaggagaatagaaaaaagccgccattacggcagcttctataaaagaaaatctgcaacttttacaagttccagattcatcaaacagatttattagagattccttttaatacaaaaccaattaatacactatatgtacaaaccgctccaagcaaaaacagcattgtcatttgcttcaccatcctgattgagaatctttttcaaattcattttaacatagttgagaatgattttcaatcgctattttatgctgtattcctgtaatgctttgtcttctgcgcgaattctgacgcttaacaacacggcattgaaaatggaaaacagacacatggtgacgtatgcttgataaagcagcggaatcagcaaaatttcgagtataacaacggcatagtttggatgtttcatccatttatatggacctttttttacaagctctacacctggaacaacaaggattttcgtattccaatatgcccctaaggaacaaagcgcccaataccgtacgatctgtacgcttaaaatcactgcagcgataccgagccaccagctggacggctgtttattcatcagcagcacttcggcaattaaggacaggaaaaaaaggatatgcatcgtaatgatatatggatagtggctctcgccaaattcaattgctccttgcttctttaccttttgttcgttttgcctggccactgccatttctgctgctctttgaacaatgagaatggcgatcatcaaccaaaacatgagtcaagcccccttttcccagctgaataatagcaactctgatgagaagcccggccctaatgcgccaatcagtcctcgttcatcttcctttttatgtccgttctgcagatggtctttgatcacatacaagattgtggctgaagacatatttccgtgcttttgcaaaatgctttgcgcagatgaaagcttttctgacgacagcccgagacttttgatgtatgcatcgatcactttttttccgcctggatgcgccaaaaaaacactgatatcatggaatgacagcttatgtttgtccaaaaaaatctgtacatttgttttgagccatttttccaccaaggtcggaatgtctcgtgagaaaatgactttgaatccttgatcggtaaagtcccagcccatgacatcttctgattgtttcatcaaaacagattgggcgtccattatcttcggcgcaagcttcagctttgacatcctgcggtccgccttctctccgcataataaagctgcggcaatgccgtcaccaaaaagcgaggtgccgatcagattgcttttcgttttatcttccggctggaatgtcaggctgcacagctcggcagcaatgacaagcacaaaagcctcaggatacgctttgcagtattcggctgcacgcgcaagtccgctggctcctcctgcacagccaagcccccaaatcggaatccgcttcgtatatggagaaaacggaagttcattcataagccgcgcctcgatactcggtgtggaaagacctgtactggagacgaaaaaaacagcttccactttctcataaggaatggcttcttgaaaaaattccggatgagagaggcactcacgaacagccgctctgctgtgtttaagtgtttcttctatgtatatttgatttttttcttcaaagctgtgcccctctttataccattcaatcggcttaacaaactgtctcgaatggatttgcccgtttttaaaggaggataacagccggtcaatatccttaaaagaatgctgaaacatatagcgggcgaactcggccgctttctcttggtttacattatacgcaggaagacttgttccaatggataaaataaacgccatgcgatcacctctttgcatacattgtgccgcaacaatcttttttatatgcaaaaaaactccgccgcggcggagttagactgctgttttttgttcagcgaggtcagcttcttgttctatttttttagctttagaaaaaaagttatatacaatatttaagacgactgcagtaaagctgcccgccacaatgccattcgttgtaagcagcgttaaggcactcggaagctgtttgaaaatatccggcacaacggtcacaccgagccccaatcccactgagcaggcaacaatcagcagattttcctgtttcgcaaaatcaatgcggctgagcattttaatcccgtaagcgatcaccattccaaacatcgccaccattgcaccgcccaaaacagcggatggaataatggtcgtaaaagcagcgatctttggaaacagcccaaatgccattaggatcacacctgtgaccacaatgacggcattttttttgatccctgtgagctgaacaagcccgacattttgagagaatgccgtataaggaaaagcgttaaaaataccgcccagaagcacagccagtccttcagctcgatagcctttagacaaatctttctctgtcaaacggcggtttgtcaggtcacctaaagcaaagtaaacaccagttgactccacaaggctgacaattgcaacgatggacatcgtaatgataggcgctgcatgaaaagacggcgcgccgaagtaaaatggctgaatcatttgaacaactgccgcgtccgaaacattatcaaattgaacttttcccataaaatatgcgatgaaggtaccaatcaaaataccgatcaaaatcgagacggacttgataaagccttttgtaaaacggtatagaagcacaatgatactcaacacggtaaaagcaagcgcaaggttggagagatctccgaaatctgcacttccttctccgccggccatgttattcatggcaaccggcatcagtgtaataccgataatcgtaacaacagagcctgtcacgaccggcggaaaaaacgatacgagctttccaaagaaaaatgaaataagaatgacaagaatgcctgaagcgataatgctgccgtaaactgttgaaaccccatattcagatccaatcgctatcatcggcgatacagctgtaaaggtacagccaagcactaccggaagcccgatcccaaaaaatcggttgctccacacttgcagaagtgtagccacaccgcacataaaaatatcaattgatactaaataagtcagctgctcgacggtcagtcccattgcttttccgacaatcagaggaacaacaatggcgccggcatacatggcaagaacatgctgaatccctaaagacagcgttttgccgaatccacttctcatgaatgaacctcctgtacgaaggacacttttccttcttctaaagactgaattcttgccaaagattccactcgatagcccagtttcacaagttcatctcttcccggctgaaatgacttttcaataacaatgccaattcccgcaatagaagctcccgcttgcttcacaatcgacacaagcccgtgcgctgcctgtccatttgccaaaaaatcatcgataatcagcacatgatcctgatccgacagatgggtcccagacactgcgatttggctttctgtttgcttcgtaaaggaataaacagacgctgtcagcaagttgtcggtgagtgttaacgattgatgctttctcgcgaagacaactggcacacccagcttcaagcccgtcattacagcgggagcgatacctgatgattcgattgtcacaattttggtaataccgtcttttgcaaacctggacgcaaattcgtcaccaattctctgcataagcagcggatcaatttggtgattcaaaaaagaatccactttcaatacctgatcagataatacgatgccttcttcctctattttccgtttcagtgcttccatcctgtctacctccgttatgagaataaaaaaagcattgcccgctcaaataaagagcaagcaatgctgatatcacaaaaaaccgtacacgtgcggttccattgctcacccatagtcggacatttacggtgcccggtagaaacttgcgtgccatatccacgcgaatatatgagtgttcctattatattgtaataaattatatcaagattctaatctcttgcataggctgaaaataaaaattcccgaactttaattttgtttttttagatatcattcgtatttcaaggggattcgatataaaagagcctgacgacgcgccgccaggcttttgattatgacagatagagatttgaatatttgtttgataaataatcaattaaatagcgaacattcagctcttctcctgttgcatctttaataatgtctaacggctttttccgttttccgtgaatgtgcaccttttccgtcagccattgctttatcggatggaactctcctctttccaagagagcgtcaaattcagggagatcctcaagcattttttgtttcagctgagccgcatacatgtagccgagcgcataggatgggaagtagccgaaatctccacctgcccaatggacgtcctgtaaaatcccctctgcgtcggtctgcggtgtaatccctaaataatcctggtatttttgattccaaagcgacggcagatcttccacagacacttcattgctaaaaatcgctttttcaatttcataacggatgatgatatgaagaggatacgttaattcatccgcttcgaccctgataaatgaaggttttgattcattgattgcccggacaaaatcatccagggagatgtccttgaactgttcaggtgatgcttcttgaatcttctgatagtacggtgtccaaaaatgcttgttgcggccgataaaattctcgtaaaataatgattgcgattcatgaattcccattgatgcgccgtctgacaagttcgtgccactgagtgcttcatcaatattttgctcgtatatcgcgtgcccgcactcatgaatggtgccaaagatcgccgtccggaaatctttttcatcatatctcgtcgtgacccgaacgtctccccggttcagcgtagttgcaaacggatgaacggtttcatcaagtcttccgccatcaaaatcgtagccaagctcctgtaaaaaatacagactgagctctttttgcttttctttcgggaacgcttttgtaagaaagcttgtatctggtttatttccggaagctgtcacctgtttaacaagagggataatcgcttccttcagctcagcaaacagctgatcaagcacctttaccgtgacgccgggctcaaacaaatcaagcaatgcatcataaggatgctcttgatatccccaatacgtaataaaacgtttattgaattcaatcagctgttctaaataaggagaaaacaagctgaaatcagattttcctttcgcttcctcccacgctgtttctgcctttgaacacagaattacgtattctttgtattcagcctcagggattttcttattctcttcatactcttttttcgccagttccactgcttttttcgtatcttccgacaagtcatcaaatcgttcatacaggacatcgataagctccttcattcgatctgatgtttggatattgaatatatctgttgaaagctggccgatgctttcggcacgatcctctgagccgtttttcggcgcgcctgttctggagtcccagtgcattaacgcaactgcttcgctgtaatgtgagattctttttaaaagatcaaaaaattctttttcatatgtatgtatctccatatccattccctccctattctagccgttccattacaggctaatggaagggggtatgaaagtcaaattgtttgtataaaaggctgccggtatgttttgcggcagcctttttattcagttgatcgtcatttgattttttggcggaggtgttcttcgctttttctgcttgatttttttatccacccacactgttgccagcggggttaagagcgaggtgacaataacgcttgtcgctataattgcagttgccgactcagcaactggcgcaaatgaggcattcgcttccgctaatgcgtatggcacggctacagccgcccctgccgtagaagaagcggccacacccgcgacaccgtctccccgcgcgacaaaacgatcaagtaaaaacaaggaactgcccgataaaatgacgacagaaactccgataaaaatgccgagcagccctgattggatcagcattccaaaattcaaggtattgccgagcgaaaaggcgaaaaatggaatgatcgccggcacaaccttgctgaataagtctctgagatcgtgatccagatttccaagtatacatccaagtaaaaacgggataactgtcgctgccagcgtttcccatgggaatgcggcaagtcccgtcacaccaaacgtcaccatggtcataaaaggaccagattctgtactgataaaggcgaaagcgcccgcatcctcttttcttcccatgtgattcatgagcgccaaatacagtccgccgttcgtttcattcattaccgcgacaattgctaaaacagaaaggcctgcaaaaaagccggattgtatgccttcgtcaggtataaattgcgctgcgatcacgccgagcagtgccgcaaatccgacctttcccaataataacgtgattccttttcttgcgatatagcctgaagaacgaaaatcaatcgttgctcctacgcaaaagataaaaacacccagtattggcagcgttccggtaatcaaagcacccgtaaaccctccaaagaactccgctgttccaggcgcaaacgtgttgagcgccgctccaagaaatagcggaataatcatcattcccccaggtacccgttcaattgtcgccttgattttcatattgtggattctcccatcctccggttatgaaaaaacaatttcacttacacttggaaaacagcctgcaaatcctcttttgaacagctgcccagctggctgccgactccgacggcgccagctccggctctaagccaatccggcacttcagacggatgtatcccgcctgtcggaataaaggtcacctgcgggaaaggacccgctaaatttttcataaacgggatgccaaacacaccgcttgggaacagctttaatgtcgtaaaaccgaatgtcagcgcttccataatttcgctcggagtcaagacgccggggatataatgtgtctttacaaaagatagatgttcagcaagatcagctgaaaaacccggactgacaataaactgcgcgccagcctcagcagcttccccagcttgctgcgcggtgatgaccgtgcccgcgccaattaaaatatcttccctattacggaaggattcgataatatctgatgccccgggggtcgtatacgtcacttcaactgcacgaatccctttatctaacaaactctcaatctgctgacaggcctcctgcgtatcctttgaacgaatgactgcaatcagctttgcttctttcagacggttttcaacgactttggactccatattaataatcccctttcttttggtgaaccgttctttgagcagataaaaaagaagctaatttctccctggtcggcaaaccgtccatatcccccggtgcctgcacttgcaaagcgccaatcgcatttcccctttgcaccgcatccttgtacgacaaaccgtctaggataccgctgattacaccgactgcaaatccgtctccggcgccgaccgtatcaaccacccggtcgacccggcagccttctagaaatccttcacttgtccccgttttaaagtaagcgccttcttttccaagtttaatagcaacaaagctggcaccttttttcaaataatagtcggcaatgccttcaggtgttttttctccggtcaatagctctccctctgcgatacccgggaaaaaccagtctgcaagcccagccagatcattgattgtgtgtaccattgttgcttgatcaggccaaagcgaaggtcttacattagggtcgaatgaaatggtcttccctgcgtttctcatgtcgttcatgacatgatacgtgaagtctttcatctcggctgacaaggcaggcggaatgcctgtcacatgcaaatggcctgcgcattgaaaataatctctcggatattcagctgaagttaatgtgcttgcagctgagtttttcctatagtaggtaacttgcgggtcgccttctttcacttttgacttcagcagcagcccggtgggattttcgtcctgcgagcggatcacgcgggacacatccactccctcttttttaagttcctgtacaataaacgttccgagctgatcattgccgaccttgctcatccatcccattcgaaacccgagtctggcaaggccgcaggcgacattgctttctgctccggcaagccctttagaaaaagtggatacttcatgaaggcctccatactcatttgcataaaacatggccattgattccccgaatgtcaccgcatcaagcttcatctcttcccaacctcctcttagttgagggcacctaggattaaagtgactttctcatgatgacttttgcctctaattcaatggtttgaggcgctcctttgtcaccttcaatcctttttaatacacgttccatcgccgtcctgcccatatcatgtgacggctgggcgatcgttgtaatacctggaccgatcagtttataccattccgtatcatcgaatcctgcaatccctatatcttgagggatgcgcaggccaagctcttccatacagctgatgattttcagcataatcaagccattcaaagccagaatcgcttttttttgctccggcatttccttgtgaaaagaacgaagcgccgccttaagctgctccttgtcctttacgtcaatttcaagcaatctgacaagcccgttcacattatgaaccgaagccattttctgatacacagctgctctttctgcacgagggctgatagaggaaatcggttcggtaaacagcgcgacatcagtataccctttgctgtacaccttctgaagaatctcttttgtgatccatctgttgtcagtcgttacggtatccagtttcagatccggcagtttccggtcaattaagattgttggaatttgctgttcagcaaaagcgcgcagtacatccttgttttcccctgttgcgtttaaaatcaagccctcaaccgaatgggcttctagctttaagagcatttcccgctctttttcaggactgttatctgtgttgcacaccataatgctgtatccatattgatcacaaacctcttcgactcccctgaaagcagcgaccgaaaaaggatttgtaatgtcagctacaacaaatccgattaacttgcttttttttattttcaaaccttgcgccattttactcggccgataattcaattctgcaattgcctttttaatgtttttcactttttcaggagaaatcgcgtcaatttttccgttaatatagcgggaaactgtcgatttcgaaactcctgcacattcagctacatctttgatggttgtatggcctgttgttttctttttcattcaagtgctcctgtatctcttatatttgaaaccgatttcaaaaccgttacaacaaaagaataccataattttaaaatttgggaagagtttttttaataatgtgtcaattcattattttttcgttgactcttttcactatttatcctaaaattttctttgaaaccgttaccaaaatattttcattcaagtgatgctgaaatcctaaccaagggggaaatataatggaaaatcgttattctgtacatcctgaacaagtaaaacgctttacaacagaggagcttcgcagtcatttcttaatggatcctttatttacagaaaacaaacttacgatgtattactcacatgaagaccgggttgtcatcggcggagcggctccagggcaaagtgaactgaagcttgatgcaggtgattttctaaaaacagacttctttttggaacggcgtgaaatcgggattattaatgtcggccagcctggtgccgttagagtcggcgatgatgaatatgtgcttcaaacaaaggattttctctatatcggaatggataatcaggatgtatcattttcaagcctgaacggggaaaaagcgaagttttacttcgtctccgcttgcgcccacaaaagctatccgacacaaaaagccgccctagctgaactgacaccggaccgccttggtgatgatgcagcgtctaatgtcagaagtctgtacaaagtcattcatcaggatggcattaaaagctgtcagctgatgatgggaataacgatgttagatcaaaacaacaactggaataccatgccagcacacgttcatgaccgtcggatggaggcttatctttatctggatcttgaaaaggactcaaaggtatttcatttcatgggccagccggacgaaacacgccatcttgttgttggaaatgagcaggctgtcctttctcccgcctggtctattcattctggcgcaggaacatcaaactatagctttgtgtgggcgatggctggagaaaattacacatttacggacatggatctcgttccgatggatgggctgaaataagatgggttatctacatgacgccttttcattagaaggaaaaacagcgctggtgacaggccctggaacagggatcggtcaaggaattgccaaagccctagccggtgctggcgctgatattatcggcacatcacataaaagcagcctgtctgaaacacagcagcttgtggaacaggaaggccggatatttacatcttttacattggacatgagcaagccggaagcgataaaggattctgcagctgagctgtttgaaaacaggcagatcgacatccttgtcaataatgccggcattattcatcgggaaaaagcggcagattttccagaagagaactggcagcacgtactgaatgtcaatctacacagcctgtttattctgacacagcttgctggcaggcacatgctgaaaagaggtcatggaaagattattaatattgcctctctcctgtcttttcaaggcggcatcctcgttccggcttacaccgcgagcaaacacgctgttgccggtttgacaaaatcatttgcaaatgagtgggcagcgtcaggtattcaggtcaacgcaatcgccccaggctatatttctactgcgaatacaaagcctattcgggatgacgaaaagcgaaatgaggacattttaaagagaattcctgccggccgctggggccaagcggatgatatcggggggactgcagtctttttggcatcacgtgcttcagattatgtaaatggacatattttagcagttgatggcggctggctatcccgctgacaaataaaaaaagctgacgaacgatcgtcagcttttttccattacatcatgtgcggttcaacaggcaagacctttttgacctcatcaatgatgcgttcattttctccgccagcgtaaatgtgaattgagccgctgtcttgattcgaacgaatcaggcgcccgatgccctgccgtacacgtaacaacatatatggcagatcaacttcttcgaacggatcttttttcgctccgttgcgcttcgctgtaaatacaggatcgtgtggcggaaatggcaatgaccaaatggtaacattcttcaatgcgtcaccgggaatgtcgagtccttcccataagtgaactgaacaaagtactgtttcctcttcctcttggaatttctctactaagctgctgatttcctcatcaccttcgaagaaaattggatacggcagctcccatgccgccgacagctctttaaactcgtttaattcttcaaaagaagggaaaagcaccagcgttcttcctttgtaacgtttgattgtttcaatcgtttcagccgttttttgttcagcggccatatctgtttttgcgtatagattaatactcatttgctcgtcataatcataaggggaatcaacagttaatgacaaataatcatgaatcccaagactgtcggcaatataatcaaacgaaccgccttctgacagcgtagcagaagagaagatataaggaattttcttagaaaacactttttcgccaagtacttctgctaccgttctcggcatcacgacaaaggttgattctgcttcctttttctccagccagctgatcgcatccttttgatatagagataatgaatacgccatttgttcaacatattcttccactactgacagttcgtattgatcaatcgtatacatttcagactcaaatacaagtgcctcaccgattttatcaagtaaacggcaaagctcgtccgccgcctttttgacacgatggtcattttttatttctaaacggtgtgaaccggctacttcctttgattcttcagaaagaacatagaaaaattcgtcgtttgcgagaagcgcatcttcaatcaattctgcaaactcttctctgatgtcattttgcagcaatcgttctaaaaacaattcaagagtagactgcttcactctataggttagcgctttttgcgcagcaaactctaacaagtgcccctcatcaaatacaactgcactatgatcaggcaagagcggcagctggccctctcgtttgcgtgattcttccgtccacacatgctccatataaaaatcatgggaacatatgattaagtccgttgacttgcgatagtaatctctggaaagtgtcagaccgcatctgtgtctcatatcacaagtcagacagtcctgaaacgagtcgtagcttacgtcagaccactcttcattcgatagatttgcgtactgcttacggtcgccatacggataaaagcgctgcatcgcctgtgactcgtggacaaatgacggtaacgactcataaagatccagccatttatcatcatcagaacgctgcattgttttttcaagcttcttcaagcataaatattgctcatgcgattttgacagccttgtatcaattttcagatcaagatgctcagccagcttagaaatatcgccctcttttttcactagctgttcaattaatgtttcatctgcacaagcgatgatggcgggtttgccgacataccttgcatagctgattgcaaaaagaagatataccagcgttttccccgttcccactccagcttcggcgaacatgacttttttctctttaaacgcccgctccagctgaaaagccataaatacttgctcgtcccgaagatcaaaccctttttcgggaaggatatcgtaaaacacgtcaccaatccaattgttcaattcttcataaaaattctttgttttcgttaaagaaaaaggcaaacgtgatgttgtcacctagttccaacccccaactattcgacattcagaccaccaataatatcattttccgctgatgaatacaataaaaaaacttggcaatgccaagttttttgcagtttacttacgattgatcacatgcgacgataaaaaaggatggtctgttgaataaatatgttctaccgctttttctaaattagtttgcgcatgcgaaatcatagacggagacgattcagtcccgagctccttcagctcgtttgctgttgcgtcaagcgccctttgaataagattaaaatgttcgctgttcagcatgagatcacctctgatggaaataatcatcattgtatgcgaacttttcattttatatacatgctttaccgcatgttatcaccgaaacatgcacaaactacacttgatattccgtctccggattatccgtcttatcaacaatattctatcagggagtgatgttgacatgagttatagaaaccgattagatcagcattctgaactgttccatcacaattggacgcggcctaaacgttctaagtctcaagtaaacggtcacactgaaatgtcccaaaccaacattatattgagaagcaacgcgaaagctcaccgttggtaacgatagaatagggctgaaagatgaaagaagacgcatgcagagcgtcttctttttatgcgttttctgttttcttgcgctgcggccttacttttgaccaatattgataataatccgttttaataaacccgttaaagagctttcgtttcttcgttgcttttctgccatatgcttcctcaaagttttcatttgatgtcagcatatacacagaccaagtatcaagcggctcgaacgccttccccatttctttgtacatctgctcaacggcttttttctcgccgagacgctctccatatggcgggttgccgacaattacgccaaattccagatttgtggtaaagtctttgacctgcatctgtttgaactggattagatctcccaatcctgcttcctctgcattttcttttgcgatttgaaccatgcggtggtctatgtcgctagcgaaaattgtaagcggctgatcataatttgccttttcttcgacttcaagccgcgctttgttccacagatctttaccgatccattcccaatcctctgaaacaaaatcgcgattgaatcccggggcgatgttttggccgattagcgccgcttctatcgcgattgttccggagccacagaaaggatcaacaaacgggcggtccggcgtccaattggttaattgcaccaaagcggcagcaagtgtttctttaatcggcgcaccgccctgatcgacacggtatcctcgtttgtgaaggcctgtccctgatgagtccagtgtaatcaaagcctgatctttcaataaagaaatttcgactttatactcggcacctgtttcttcaatccaatcattggctttgccggactgcagcttgagcttttcgacaattgcttttttgacgatccgctgacagtcgggaacgcttgcaagtgttgattttaccgattttccgataacagggaatttcccgttttcaggtataaatgagcgccagttaatcgctttcgttttttcaaacagttcatcaaatgttttcgctttaaaagaagcaacctgaacctttatacggtcggctgttctaagccaaaggttggcacggcagatggcaagtgcatcaccttcaaaaataactttcccgttatcaaccgtgcattcgtatcctaaatctcgtacttcctttgcgacaacagcttcaatgcccatcggcgccgttgcaattagtgtatacttcttcatcgtatcaccctgtcttttgaaacttttctcttttcaagataaaagctctccttatacgggagagcttgttttcatcattttaaatgtaagtggtctaacgttctgtaagccatgttttgttccgtcgtactgcaaacggctcatcacctcgtactcaggcggcaatcatctatctacagaaagcattctgtccttctctccgttgaattccgttaagaaggttcccctaccaaaatttgggtttctcgctcgaggggtttaccgcgttccactctcaccatttctagtgagacttcgtcactgtggcactttcaaggatactcagccatatccgaagacgtaggcttttttcctgccgtcagtctctaaagactgccctagcttatgacttcgctaggcacgaacactacgggcatctcagcaccgtgcgagcatggactttcctctacagattcaagatctgcagcgattacccgaacgttaagaacatgaattattatataacaactgtttacaatttacaagcgccatttttttcaagcgtgatcaatcataaagcttgctgccaaaaacgtgtttttctaagttagacagccgttttaaaatatcaaagtttgttgtgttagattgcacaggctgttttttgctggcttcttcaagctgttttttcagctgcagattttcctgctgcagttcttcaatttcttgatggaaggtttcataatccttaataatcatatctaaaaatttgtcaacgtcttcttgcttgtagcctctaacgcctgttttaaattctttttccaaaatttctttcgcagaaagctttactttatcagcaagcatctttttcacctcgtatcgtgaatcatcacatatattttttcagaaatctgtacggttgtcaaatttctctctcattgttagtagctgtcttcctccactgtcactctcaagtcatccattgtaataaagtagatgggatagccatcctgttcgcgccttttttccgctgtcccaagcatatacttaggggagccttccttttccgggtcatataaaagcagaagcccgtcggacttatcaatgaagaactgatttttttgtttgaattgaagcgggctttcataaggacggtgagtcaggcttgcttcatagtctgcctgagacagaactgcttcatactgttccttattcggttctttccagttcttttcctgctcgtaaaatggtgtgatgacagctacttttaagtcagggtattcctcctgcaaatcatatgcagcttctgccgcccacagctccgctccaagctggcccgaaattaaaatccattctaatccttcatccaaaaaagcaatcagccgattcttaatggctttttttatgtaatacagcgccttgtcatcctgcttaaatatcccgagttcaaacggtttatagcccgtaattgccagtactttcatcatttcacctgctttaaaaaatggggctcccgtgggccccatttgttgtgctgcattgtttacaccatcaagctgcacgttttccatactagtagtcgcagcaaggttttcctgcttgaaaatgctgatgcgtagccgggtcaacatttgagaaagtgtgtggaaagtagtgaacgtgctgaaaatgctggtggtttacgtttgttgtatgctgtgggtgaatgtgcggcacgatagtcttcgaaaacgtatggtgttcacagcaatgagtaggatggacaattggcgccatcatatgcggtctgcagtgatgcatgataaaatcccctttccataaactttattacaatactaagctatgaaaaataaggggtacatgttctgatgcaaagacctattttaaaagtgtgcaattaagctgtctttaaagtttgaaaacacaaaagcaatcaaaaataccacaacaaagaacaagtaaaaaacacccttatacataccaactctccctttaaaaataactaacgtcattttacaggattcgccgctattctacaacaaaatcaatgtgaattcagcaaaaaaaattcatggcgaaacaagtcgtcttttgcgctttcccggggaatatttaagaggaatatttcctcttcagccgggcaattctcacatgcagtttttcagtttctttctctgataagcatgccgcatcgctaagcaattgctctgctatttgcaatgcttttccggattcttttttcttatgctcaaaatatttcgcgagctctattacagcagcgtatctgcacttctggttttgcgagcgggacagcttttcccaaagcggcactgcttcttccaagcggttttgttttttgtacaggagcgataaatccagccgtgcactgtcctggtcctcaaacgatttttctataagcctttccaactgcttgatcgcttggtccgtttctttatgagccataaaccatttcgccatagcataggcttcactgtgttcttttggcgcatgtgattctgaaaggatttttttagacatatggatgtacaatgaaatgagtgataacacatccatttcattatgatgcaggacaccttttaaaagatccggctcttgcgccttgataaaatgaaagtaaagcattggcgccaagtagcccggtgtgtcttctagcctgcggatgccgagctcctctttttcaaccgtgccaagagatacacggtccattttgtgtttccacaggcgtctagctccatgcaaaagatcaaagtggccaaactccggaagcttcggaagtctgtcacggatcaaggtgtgccttgttttcacctgcggccaatcaaaggctttgccgttgtaggtcacaagtgatgtaatgtcaacctcgcttaaaaagctttggtacaaggcgacttcgttccccggtttgggcaaaagatgctgtttgactgtcactcggtcttcatatactctcgcatgcccaagcaaaaaaatggtattcccagctccacccccaagaccggttgtttctgtatcaaagaaaaagaggttgtttttgttatacccttttgctgacaatgtatgcgacaggccgctttgattccacagtgtgatcacttcttcaagctcagaaaagctgtataacccatggcggtgagaaagcggatattctacttctctgatgaggcaatattcatcttcgaagatgaaaggcttcatgccaaaagcctcccactcttctaaaaacgggatgtcatcaaagtggttttcttgtttgcctgcttctattttttgttctccttcgtcgagcgccatgtgctttttcatccgttggagtttcccttttaatgacatatccggcctccctccttacgacatttgatccaacagctgcaaaattctttcctttgcttttatcccttctatttccgtacctatacaagacggacagccgtcatgacaaggacaatgtgtaatcagttgtttcgccgcttcattaatgtctgaaaaacgtttaaagacttcctccgccaaaccgataccgcccggataatgatcatataaaaatatggttggcaatccggtatgggctgctttgatttgagaaacaacatgaacatcatttcgatcacacatgatatacacagggacaatatgctgcagcacattcgagatgccaagaagcagctgttccagtgtcttttccccgatgtcttcatccgctgttttgatttcgagccaagctgcacttgtatgcagttcttcttccggcaaatgaataggtccagacccaatattttcaaaagtggtcatttttatttttttaaaaatggtcggcagggcattgacagtgacgtctccgtagtgcaatgacgtacggcttttttctttcgttttatcgatttctaaaaccttcagctgaactgccaggtttgcatccgtataatattcgacatcgacttttctgacatacgcctttttatggtcccaatcgagcttctcaacttgatactgaacgccttcatgcaaataaatcgcttcatcatgcaaaagcgtcatcgcactaaaacggtccatttcaccgataatccttacatttgcaatatccgactgatcaactataacgacattttcctgggaggcggaacgcaaactgatgtttgaagcagggaacgactcacttgcccaatggtaccgttcgccgttgcggtgaagaacagcctcttcctcaagatactcaagaatatcactgacttccatgggtccaaattcttcatcagctctaaaaggaagctcataagccgcacactttaagtggtctactaaaataatcaaattctccggattgattcttgcagattcaggcgaacgattaaagaaatattcaggatgccgcacaatatattggtcaatcggtgttgaattggctaccatgataatcaaagattcaccgtgtcttctgccggctcgtcccgcctgctgccaagcacttgcaacacttccgggataccccgtcattacacacacttgcagctggccgatatcaacaccaagctctaaggcattcgtactgaccactcctaaaatgtcgccttctctcaggcctttttcgatttctcttcgctctttcggcagatagcctccccgatagcctctgattgattttgttccaatctcttttttcacaagctcctgaatatggcttaaaataatttccacccgaactctgcttctggcaaaaacaatggtctgcactttgtttttaaggaactctttcgccagttcattcacttctacggttgcgctccttctaatattcagcggtttgttcacaattggcggattgtaaaacacaaaatgcttgcgtccgctcggtgcgccgttgtcatcgaccagccgcatcggtttgcctgtcagctgctctcccaattcctttgggttggcaattgttgcggaagtacaaataaaaaccggatcacttccataaaaccggcagatccgctttagccgccggatcacatttgccacatggctgccgaacacacctcgatacgtatgaagctcatcgatgacgatatacttaaggttttcaaacaaactgacccatttcgtatgatgcggtagaatggcagaatgcagcatatcggggtttgtaatgacaatatgacctgcttttctcaccttttgtctgattgccggagacgtatccccgtcatatgtaaagcttttaatatcaatgcccatttcatcaataatttcatttagctcgctcttttggtcttgtgccagcgctttagtcggaaataaatataacgcccggtttgtttcatcttgggcgatggactgcaggactgggaggttgtagcataacgtttttcctgatgctgttggcgttacggtaacgatgctctctcctttttgcacatattgaaaagcggaatattggtgagtatatagttcatcaatgccccttttcgaaagggccgctttgattctctcgtctatactttcgggcataggccttgtttttgcttcccgaggctcaatttcatgccaattcacaacgttttcatttccttttaaatcagaaatgagttcagtcagtgatttctttttcattctttacacctctttgtcaagtacagtttaccgaatatttgtttgcatggctaggtgcaaattttatacagttgaataaaaaaagcaaggcatacgccctgcttatttcgctttgattgtaaggagctttgattcgcctttacgagcagccttttcgcctgccggcaccattgatcctacagcctcaccattcattataacgattgggatgactgtgctgctcgctttttcttttattaattccaaatcacatgtaatcagcgggtcaccgaccttcactttatccccttctttaatgtgggcagtaaatccttctccgttcatattgactgtctccagcccgacatgaattaacagctcaattcccgagcgagtccgaatgccaacggcgtgtttggtgtggaaaatctgaatgacttcaccttcagcgggagaaacgatttcaccgctagaaggttccacggctattccttctcccatcattttctgtgaaaaaacagggtccggcacatctgacaggtccattactgtaccgtctgccggagaataaataacctcttctgtcaccttttcctgagttttgcccattccgaataattttttcagcaatgtattttctcccttctcattcttcaaccgttatcccttcattcaccactatttaaccacactttcaattttgcttcaatttataacaacatctggcatagacgcataatctggttaaaaaaggcggtggcgaaattggaattctatgatgacaaaaagaacgaactgcaaaagaaagaagaaatcataacggaggcaatcgacactctttttcaatcctcagcgttcggcaaccttataaacggatttcagaacctaatcaactcgagtttaaaggatgtgcagacgaccatacatgtcagagaaagagatactgggctgtatatcgatattaccattccggcgacgtttcgagatggcgagatcgtcgttgatgttaaatcgaggtatctccatgtaacactccaagaaaaacagaaacaccaaaatgaggctacctttacaagcatgacaagaacggttcagctgccttatgaagttcgccaagaagatatggaaacgtcttggaacgagcagacaatgacacttttctttccaaaaaataagcatgaatgaacgattcattcatgcttctatcatttaaaaaagctggtaaatccctttattaaagatccgacctgattcattgcactcattacttgacctgtcgtatccatcattttattaaaatcaaattgcccatttgcttttttgaactgcgacataatgctttgaaattgcgaaggctgctgttgattaggccttgggataggataagggttagaaaatacaggcggctgcataggcataggctggatcggagcataaggctgataataatcctgctgtccataatgctgctgaggcagttgttgctctaaataaccgggtgcagcctgctgataatatccttgcatatgctgaggataataatagcccatttgccgaggatagcttcgagagctcccgttcattgcgattcccccctaaacacaacatatttctcttctatatatgtatgaatgacttctattgtttgtgtcacaagtgatgattagcatttgtcaaattgtgtcgaaagtttaaattttttaaaaacagaaaaaagtcgaatcattatggtaccatattttcaatacagatgagaggggatgcaccataatgaacgtatcatacttaagcaaacgttttgcagaaatgaagaaatatgaaacagactgtatgaataaactgatggactttgccaagttcctctatattcaaggacatctcagcataactgagtttcgtaacagtatgaaggttctcgaagcaaatggagcagaaagcccggcatatgagatgaattaacgtccggccccctataaaaacgaaaagaagacagccttttaccggctgtcttctcttgcaatttcatcctttactgcgtgcaatgtataaaggactgactcagtgatgtccttgaatcgttttttatgaatatgatgaacatatgattgaaggaccaattccaggaaattatcttttacggtctcaatttgctctttatgcacatattttggccggtgggcttttatcaattcaagagcaccctctgcccagcgggccgccagttcatcattctcttcaactgcaggctttatcatctcaaaaaaatcataagaatgattactgttttttccttcctgataccgatcagcgcctttttcagcaacttcaatcatttgctcggtcatttccagcaaagtttgtgatagcaatatctttcacctcaatgcctatcgtaccaaatttcactcgcaaattcagccgatgcggtataccttctcaaacgcatacctgtgttcaggcgattgatacagctcatttatacaaatatgaagatctatgatttcttcttccagcacactcaggcgatcattttccgtttcccgcatctcagcctctaatgcatttacagaatgattcaggctttgctcagctcgcgttaattcatcttctatatcagaaagcatacggagaatatctgtcttgcatacataaccggacattcgtgtacctccctttccttgtctctcccgcttaacattctttgctctcaaggctctttccttcctcatgacaaaactagaagcaaatcgccaaacaaacaggtattccacgaaaagctgaagttttcgacaaaaacacccgcaaaaattgtatgatcctcctccttaatgcaaacgatacttgtgaggaggtgccgtatgaaaacaagaccgaaaaaagccggccagcaaaaaaagactgaatcaaaggcaatcgattctttagataaaaaattaggcggcccgaaccgcccttctacgtaagaagcaaggaatttccttgcttctttattttttcagccactgctccaccgcaaaaagcgcatgaagctggcgctttttatgtaaataccagtctgtcaattcaatctgcttcggcaattcctcgcgcctaaagaacgttttctttatctttccatgaaaccaatctgttttcgttccgtctaatgagtggattaactcagggtagcatgtccttagcataggagatgttctttttgtaatcccgatcatcttttccatatcaaaacgggaacctgtgtgcggcactgtgtgcaaaaagtgataaaaagaggagaacaattctggcttgaacagcaattgagacagctgctttcccagccttatcctttcctccgcctttgaaaagcgtttcactgaaatgccgtaaaaaaacccatttgaggaaggaaaaataacggtgttaaaatgaaaccagtcacttaaataaaaaggaatcgtgtcaaaaacattctttttaaacgaaggattttgtataataggtgtttggatagtgttttgttcatttataatgagggcatacattagccgctccgtatttcgctcatgccaaaaacgggtccattcttccgacataaattgtgagacgccaaacacatgcagaagatgaaacagcggtttcccgactctttttgaccagtggtataaaagaagctgcggataggcatccgaaaaaataagccagttcgctctttcataggctaaaaagaaccatttttgctgtctctcacggagtccaagctgaaacagactgccttttaaatcagtcattgaccagcctgcattacgagaaacgaaagaagccaaaagcgaccatttgatttccggatgacggtcgtaaaatgctttataagcatttgttcttgaaatgttatccgcgttttttatttttgtctgccgctcaatccggctcagaagctttctgatgatctgttgttcttgcacgttcattcacttccgtcatgattagtttaataaggaggatgagaaagtgattcggtatcctaacggaaaaacatttcagccgaaacattcggtttcatcccaaaacagtcagaaaagggccccgtcttacagtaatcgcggaatgaccctcgaagatgacttaaacgaaacgaataagtattatctgacaaaccaaattgccgttatacacaaaaagccgacacctgttcaaattgtaaatgtccattatccaaaaagaagtgccgcagtgattaaagaagcttactttaaacaatcatcgacaacagactacaatgggatttacaaagggcggtatattgattttgaggcgaaagaaacgaaaaacaagacctctttccccctgcagaattttcatgaccatcaaatcgagcatatgaagcaggtaaaggctcaagacggtatttgttttgttattatatccgctttcgaccaggtttattttttggaagccgataagctgttttatttctgggacagaaaagaaaaaaacggcagaaaatcaattcgaaaagatgagttggaagaaacagcttatccgatttctcttggatacgcacccagaattgattatattagtattattgaacagctttatttttcgccatcatctggtgcgaaaggttgattaacgaaaggttgagatgttatgtcagatcaatttaacagccgtgaagctcgacgaaaagcgaacagcaaatcgagtccttcaccgaaaaaaggcaagaaacgaaaaaagggcggattgtttaaaaagacccttttcactttactcattctgtttgttttaggcgtagttggcggtgctgttatatttgccgtcatggtttctgatgcgccgtcccttgatgaaagcaaattgaagacgccttattcatcaacgatttatgataaaaatggaaaagagatcgccgaagtcggcgccgaaaaacggacctacgtctcgatagatgaaattcccgatgttgtaaaagaagcctttatcgcgacagaagacgctcgtttttatgagcaccacgggattgaccctgtccgtatcggcggtgcattagttgccaactttaaagacggcttcggggctgaaggcggaagtacgatcacccagcaggtcgtcaaaaactcccttctttcacatcagaagacgttgaaacggaaggtgcaggaagtatggctttcgattcagctggagcgcaattactctaaagatgaaattttagaaatgtatttaaaccggatttatttttctcctagagcatacggaatcggaaaagcggcggaagaatttttcggcgttacagatttaagcaaattgactgtcgaacaggctgcgacgcttgcaggaatgccgcaaagcccaacagcgtacaacccggtcaaaaacccggataaagcggaaaaacgacgcaacatcgtactcagtctgatgaaaaaacaaggatttatttctgattctcaatataacaaagcgaaaaaagtggcagtgaaagacgaaggcgtcgtgtcacagaaggaatatgaaaaagcaagtacaaacaaatacagcgcatttgttgaagaggttatgaaggaaattgatgaaaaatctgatgtcgatccatctgctgacggattaaagatctatacgacattagatacaaaagcacaagataaactagatgaattaatggacggagacaccgtcggatttactgaaggcatgcagggcggcgttacccttctcgatacgaaaaccggagaagtgcgggcgattggcgccggaagagattctacggttggtggctataattacgcgacccaagctaagcgacagcctggatctaccattaaacctattctcgactacggtccagttattgaaaataaaaaatggtcaacttacgagcaaattgatgactcagcttacacgtattcagatggaacacctattcgagactttgaccgttcctataaaggggtcatgtctatgcgtgaagccctcgcccaatcacgtaacattccggctctaaaagcattccaagcagtcggaaaagatgcagcagttgattttgctaatggactggggctcggattaaataaagaaaaagtgtatgaatcatattctatcggaggattcggagaaggtaatcccggtgtctctactctaactatggctggagcatacagtgcattcggaaataacggaacatataacgaaccgcattttgtgaaatcaatagaatttaatgacggcacgaagcttgacttaacacccaaatcaaaatcagcaatgagcgattatacagccttcatgattacagatatgctgaaaacagctgttaaaacaggtactggacagcttgcacaagttccgggagtggaagttgcaggtaaaacaggtacaacaaactttgatgaagcggatatgcaaaaatacaatatcgcacaaggcggtgtaccagattcttggtttgtaggatatacacctcaatataccgctgctgtttggacaggtgtagattctcaaaataagataggaaaaaaatctttaaataaaacagagcaacagattgcaaagcgcatcttcgcccagctcatcgccgatgtcgatgacggaagcggatcatttgagaaacctgacagcgtagtggaagcctctgtagaaaaaggctcaaaccctgcaaaactggcagggccaaatacgccaagcgataagaagctcacagagtactttgttaaaggcacagctccttctactgtttctaaaacatatgagaaagaagaaaaagaggaaacagctaaactgtctggtttaaacgtgaaatacgataaagacaatcaatctttaacgttaagctggaattacgacggagatgcgacctttgctgttaagcaatctgttgatggcggcagctactcagaaattcaaaacagctctgcaaaagaggcagtcatatcgggtgtgcagccaggatctgtgtacaaattcgaagtaacagccgtcagtgatgatggcaaaagtacagcttccacatcctatgaggtgccaaaagctgaagacgatgaagataaaaaagaccagcaacaaacggatgatgaaaaacaagatgatgagaagactcaggatgatacacaaactgatgattctcaaaaagatgacggtcagacggatcaagatcagacagatgattcaacaaacgatcaagacaaaaaacaagacaatacgaacaccaatccgtccgacaacaataaccaagaccaatcaaacgataacgataacgacaacagtaacaaccaggatacgtcggatggtgattcgaactctggtaagaatgattcaacaggttctgacacgaataaaaataaaacagacacatctaataaaacacaaacaaactcatcatccattgaaaaaacaaattaaacaaaaaagccgtcacctttggggtgatggcttttttggtacacaataaaaaacctcccgttttaacaggaggttttatcgattcatcgcatgatatttgtaaaaatgctttttcatttcggtaaacagctcatcaagctgaataaagcaatggtattgggtcggcttaagaagaataaattccactcgttcagcccaattaatcggctttgcgggatatgatttctccctcaattcttgccaatcgagcgatttcaccggctcacctgctgtccaatgtaacgaagccagcaaacacacaatgccctttaacatttcgttttggtcacatctcgattttcgtgtttgaaagactgggagaagtgatgctttgatgtcatcccacacttcaaataaaagcggaacgtatttcccgctgtcttcccatggcaaatcgccttgtaattccgtgcagaaatcaaaatacacgggattggtctgcaaggttttcttcatatccgaggaactcttctggccaagactgcgcaagtattgctcataagaagccaacacttcttttgcttgcgtcatcgtttcaccagtccttttttatccctcttctgcccttctctgcacaaagaaagcagcggacactccgcacagcgcggagattgggctttacagtgatatctgccgaagaaaataagccggtgatgcgtaacggaccagtcttctttgggaaccttgcgcatcagcgtcttttcaacttccagaaccgagtccttccaccggcaaatgcccaatcgtttgctgactctctccacatgggtatctacggcaatggccggcacaccaaacgcaacggataccactacgtttgcggtctttctcccgacccctggcagtttgacaagctcatcgcggtctctcggcacttctccgccgtaatcttcaataatcattttactcagcttttgaatatttttcgctttattacgatataaaccgattgatttaatatcctgctgaagctcttccagcggaacagccaaatagtcttccggccgtttatatttttggaataatgttttggtcactctgtttacaagtgcatctgtacattgcgcagataaagctacagccaccactaattcaaaaggattggaatgaaccagttcacactccgcatgaggaaacatgtcacctatcttgtctaaacagaattcaatttgttttagatttaacacgattgtcaccttttcactttattgttcaagccaattgtaaaaaggaacctgccttttatactctttttgcggttcattctgctttgcttgtacacgccggaatttttggctgtgtatttttgcctgctccacagttttaagcccgtttttcttccattcaaacaaaatccggtcaatgtagcggaaactgagttttcctgatagtacagcctcttttaacgcgtgtttgatcagttgtgcgtcatgctggtcctggtcctgccagatcgccagcgtttcacactccaaaggcgataacggccttgcgaactcttcctcaaaaatggtataaaggcttttttgttccccttctgcttttctttcctgtgtttgattctgtgcaagctgaatatactcgtacagcttgccccataaaggctgaagagaatatttctcaaatttgatgccgttttgatcctcgcattcttcaataaacagaaagcctttttgaataaacatccgcaatctgtttgtgcattcttcaacagaaattgacataccttcctgcagctgattcggtgtaggaaaatatgatcctttttctaaatgcattttaatttttaacagcagaataagttctgtttcattaagcccaagctgtttataatgcgtgagcagaagattggggatggttgatgttccctgctcctgcatatcaataaattgctgttttttcatcgtcacacctcttactgtaaaggattgtgattacccctttactgtaaaaagtctcccttgcaggagactcttttttgtttcatttgaatgtattacggatacagacggtttaacagtcttgggaacggaatcgtttcacgaacgtgaggcgctccgctgatccaagctactgtccgctctaatccaaggccgaagccggaatgaggaactgatccatattttctaagttcagcataccatttatatgcgtcagaatccagtccatgttctttaagacgcgattccaaaagttccatatcgtgaatccgttcagacccgccgatgatttctccatagccttccggcgcaatcaagtcagcgcaaagcacaacgtcctcacggtcagaagccggctgcatatagaacggttttaaggacgtcggatagcgagtgatgaataccggtttgtcataatgttcagcaatcgctgtttcatgaggcgctccgaaatcatctccccactcgatatcgtcaaagcctttttctttcagaaattcaatcgcttcatcatacgtaattcttgggaacggggctttgatttgctcaagttttgacgtgtctcttcccaatgtgtttaattcaattttacaattcttaagaactgattgcacgatgaaagaaacgtaattttcctgtacttgaaggttttcttcaaattctacaaacgccatttccggttcgatcatccagaattcgattaagtgacgctttgttttagacttttccgctctgaatgtcggtccgaaagagaatacttttcctaaagccattgccgcagcttccatgtagagctggccgctttgagacagatacgcatcttcatcaaagtactttgtcgcaaagagttctgttgtaccttcaggtgcgcttccagtcaaaatcggcggatccacttttacgaagccttcgttattaaagaattcgtaagtcgcgcgaatgatttcattacggattttcatgatcgcatgctggcgctttgaacgcagccataaatgtctgtgatccatcaaaaattccgttccgtgttcttttggtgtaattggataatcggtcgcttcgtgaatgacttcaatatctgtcacagcaagttcatatccaagcggagaacgctcgtcctctttgacaatcccttttatatagagcgacgtttcctgcgtcactgatttagctgtttggaaaatgctttcttccacttccgcttttactacgacaccctgaataaaaccggtaccgtcccgaagctgtaaaaacgcaattttcccgcttgaacgcttattagcgacccaagctccgatcgttacttcctcacctacgtgcttgtacacttggttgattgttgttttcaacatatttccctccaaaacaagaaagacattcggaagctcattgccccgcgaactcttttatcatcactttattatacccgctcttaactaaccgggtcaatgcagataaaaagcggcttttctgtcagccgctttttgatctgttagctatgtttttctacaaaacgcttgattctttcaatggctttttcaagaagatctaacgatgttgcataagaaagacggacattctcaggagagccaaatccggatcctggaacaatcgcaactttttcctcctcgagaagcgctttaacaaattcatctacatctttgaaaccgcaagattgagctgcctcttttgcatttgggaacaagtaaaaagcaccttccggcttcacacagctgaaccctgggatttctatgagctttgcatagatcgtatttaatctatgttcaaatgcttctctcatttcttccaatggctcagaaggcccgttataagcagcaatcgctccgtattgtgcgattgatgtcgggtttgacgtgctgtggcttgcaaggttcgtcatcgctttaataatgtcttcagagcctgccgcataaccgattctccagcctgtcatgctgtgggacttcgatacgccgtttataatgaccgtttgctctttcagtctgtctgacagctgtgcaatggaaacatgtttctttccgccgtatgtaagtttttcataaatttcatctgacacaatcaagatatcatgttcaaggcacacttcaccgagcgcagacagttcttcttccgtatacatgacaccagtcgggttgcttggagagttaataacgattgcttttgttttttccgtaattgcatttttcagctgctcaggcgaaattttgaagtgattttcctcaagcccttctacataaacaggctttccgccagcgagtttcacctgctccggatagcttacccagtaaggcgttggaataataacttcatcttcttcatccaaaatcacttggaaaagggtatacagagcatgtttggcaccagtgcagacaataatttgagacggtttgtattcaatattctggtcgcgtttaaatttctctgcaatgctgtttttcagttcagccaaaccaccggaaggcgtgtatttcgtatggccctcgttcatcgaacgcacagcggcatcaataatatgctgcggtgtattgaagtcaggttcgcctgctcctaagccgatgacatcatggcctgcggctttcagttctttcgctttcgctgtgattgccagtgtggttgatggtgttaatgcggatactcttcttgccagtttcaacttgaactccccctaattcgtcttaaggcgtgatatttttgagaatctttccagttgtaaagtccacataacttaaactgtattgcccttctttgtctaagtacgtcacttcccaaagcaggacgtttccttctcttgccagatgaacctctttttgctttgaaaccagcccttcatcctttatgattttcgccgctttgtcttcagagattccctctttcgcttcttttgagagaatttttgcttttttatcagcaggaacccagacatataatgcagtgccttttttatccgttccctttacaacataatatttttcttttccgacaaatgtttcgacttgatcaacattggcgagatcggtttcttttttagcttcagcagctgctgcttcgtgcccctcttccttttgtgccatggctgatttataaatgcttgccgagacaagaagtactgctaaaaaaataataccaaaaatgacggtaaatattaatgctttttttctcatcttctcacctacgtacgataaatggtaaaaacggcttggtttttgttttcttcatccagtgcaaggccgaacatcagattttctcttttcagtgtacgattcaatgtgtccacaattttatacagatcatcagaatgctctacattaattgttgaaagaatttcgattttactttccattttttcatcctccagtttgaacaaatattgtaagtcatactccatttcaggacacgccatactagtatcacagagcgggaaatccgcttttaaataaaacaccatcctactcccacaccgcaaaagccgctttatgcggcttttattctttttcccctgcaacataagcttcaagctcgctgtcagtcatttcggatactgaggttgtcggcaaggcatcaagaaacagccggccgtaaccagcggttttaatccgtctgtccaatataataatcgttcccttgtctcccgcagaacgcagcaagcgtccgattccttgcctgaaggtcagcacagcttccggtaatgacactgtttgaaacggattctttccttttttgcgggcaagctcacattttgcagcatgaagcgggtgatcaggggaccggaatgggagcctcacgatcattactgtcgtcagctcatcaccagggaaatcaacgccttcccaaaaatgatttgttccgagcaggatcgcctgattggatgttttaaaagtcttcatcagcttgccgggacttccgcctgtaatcccttgtgccaagagctgaatgccggaagcactcatgttatgcttaagctcctggtgaacctttttcagcatatcatgggatgtaaacagcacaagaattttaggctgtttttcctttgccatcagttcgatataacgggctgtatcctgtataaattcaggttgccctgtatcctgaattgatttcatttcctttggaatcatcacctgcatacgctcatcgtaagaaaagggtgactcaattctcattgtccgcgggaaaaagtcactcagtcccagtcgttcaatcataaattgaaaagaaccttcgactgtaagggttgcagatgtcagcaccacactatttttgcgcgcgaaaaactgatcagccagaagttcaccaggttcaagaggctgtgcgtaaatggccactgcatttttcgcaccctttgcatctatttcaatccaaaccgcttcatcatcatcagacccaaagaagagcttctgcaacgtctgacagtaatgctgcaagcctttcatgcttctttggtattcatcggctaaaaagacggttttgctcttcatacccttcaaatgtttttccatcagggatgactgcgcctcaaaaagctgctgcaaatttgtcagcatggaacaaagcctctccgcaccatccgttaagatcgaccagcttttatcctggctttctttgttcaccttaaacactagacggtttaagtcttctttaggttttcttcgtttgacaaaagaatgtacagagctgaagaaagcatcactttctgcttgaacgtgctgaagccactcttccaattcgaaaaatgaatcaaccggcaggctgtttcgctggaatagctgtctcatcttttttagaagtccctgctccttcagagtgccgattctgctcaatttcgtatgcaattctatgtacgtggctcttttccctaaatgttcgcttgccgcacgttcaaaatggtgtgcttcatcaataataaatgtcccgctttcgggaagcctttttttctggctgccttcatcggtcagcaaaagggaatgattggtgattaccaaatcggagcgcatagcaatctgtttggcccgctcgtaaaaaccgatcacatgctcactgcgacttcttttataggagtcatcgtcataagccaatctgtcccacagcaattttccgcctgaaggcaaattcagttccgctacatctcctgtatttgtctctgtcagccaaacaagaagctgtgcctttgtcagtacggcatcataattatcatcttcttcatgaagcacctgctcaaatttatacaggcataaataatgcgattgcccttttaaaatcgccgctgttaccggaaatggaaacagatcttggacaatcggcaaatcctttgtgagaatctgctgctgtaaaagcgtcgaatacgtgctgattatgaccggcttttttgatttcttggcaaaaagcgcagccggaataagatagccaatcgtttttccgatgcctggaggagcttcaatcagcgcatgctcacgattggcaaacgcatcagccacctctctcatcatcatcatttggccgtctcttttttcatacccaggcattaactctgacagcgctttttcatttcccgcttcccagctttcgatctcaaatgagaagttctcgtcctcatttatacgaacatcgatagcttcaggttctctgacagaaaacgaagaaaagcgcgtatagcccggtatctcggtatgtctgttttcattaatgaacatatccaacaaatgcgtcagatcactgatgaaatgctgcgaaagccttcttaactgctttaatgtcggataaggaagctgccgcagcttttcaaggatttccaaaaaaataagccctgtcacttcagcatcgctgtcagcccggtgcggctgatcatgccgcagctgaagctcctcgcttaattccgtcagcttatacccttcaaatcccggaaaaacaatgcgtgagagctcgacagtatcaagcacttcacaatctgggagctgaaagcccgccttatgtagctcatacttgacaaatccaaggtcaaaatggatattgtgggcgacaaaataagcgccgtcaagcaattggaatacttcttcagcaactgcttcaaatggctgttcattttctaccatttgattagagattccagtaagctgctcaataaaagcagggattgatttatttggattaatgtattttgaaaaccgctcagtaatttgtccattttcgattacaaccgctgcgatttgtatgattttatcgcctttcttcggcgaattccctgttgtctctacatctataacaacgaaccgttgcttattcattaaaatggacacctcaattcttgcatacgacaaaagtgtaacacgttttgtacggaaatggagcggcaaaaccgttttactctcaaaatcttaaaagaaaacccccgataaagggggcttttcttctacaaaattgtacgggcgggttcgtttcccagcatttgttcaattttgttttgatcattcagaacagccactttcggctcgtggcttgccgcttcttgatcagacatcattttgtaagaaataataatgaccttatctccttcctgcacaaggcgtgcggctgcaccgtttaagcatatgacaccgcttccccgtttaccaggaataatatacgtttcaagacgtgctccattattattattcacaatttgtactttttcattaggaagcattcccacagcatcaatgagatcttcatcaattgtaatgcttcccacatagttcaggtttgcttccgtaacagttgccctgtgaagtttgccgctcatcattgttcgatacatattatattctctccatttctcgaatatcaataatgatgttatctattaaacgcgcttttgaaaaagcaactgcaacagcgagaatcatctttccagcaatttcattcacaggctcgagttccggataggaataaagctctacatagtctatggttccgctagtcgtttcaatgatttcttttgcagcttttatcaccgcttcaggatctctttcaccggcttggatcagttccgcacttgtttgaagggcccgatacagcttaggcgcttcttttctttcctcagctgttaagtatacattgcgagagcttttggctaagccgtcttcctctctgaccgtatcgacaggaaccaattcaatatccatgaagaagtcactgattaacccatcaacaacagctacctgctgcgcatcttttaaaccgaaataggcacgagtcggcttgactagattgaaaagcttcgtcagtacgatcgcgaccccgtcaaaatgtccttctcttgagcgcccgcataacacgtctgtgcgtctttctacatgaatcgtgacattcttttcaccgggatacatatccttagtatctggcgtaaaaagaatatcaactccggcgttttctgcaagagctgcatcccgctcaatatcgcgcggatatgcttcaaaatcttcattagggccgaattgtgcaggattcacaaaaatactcataataacggcgtcgttttcttgtcttgctttgtctgctaaggttaaatgcccctcatgcagaaaccccatcgtcggaacaaatccgattgacttgccctctgaatggtattgttttatggcttctttcagctgtgtaatatcagtaatctgtctcatcttattttcccccgtacaagccgtcaagcactgtctggttcatttgaaaggaatgcttttgttcagggaaagcacgatgtcttacatcctgaacatatccgctgattgctgtttcgatggtttcatcaatgcgcgtatattgctttacaaatttaggtgttctctcaacaccgtggccgataatatcatgataaacgagaacttgtccgtctgctttcacaccagccccgattccaatgaccggtatgcttagcgtctcggcaattttggctgtgagttctgccggcacacattccagcacaagcatcatagctcctgcttcttcgcattttatactgtcttctattaattttttggcgctttgttcgtctttgccctgtactttatagccgcccagtacgccgactgactgcggtgtcaaacctaagtgactgactactggaatgcctccaagcgttaatgcgcgaatggattcaaacacgccttctccgccctcaagcttcagtgcgtcagctccgctttcctgaacgatagccgctgcatttttcagcgtatcttccttggacaggtgataagacataaacggcatatctgtcacaataaaggtattcggcgcaccccttttaacggcttttgtatgatggatcatgtccgcaactgtcacaccgacagttgaatcaaggccgaggacgaccattccgagtgaatcaccgactaaaatcatgtcaactcccgcttgttcagcaagtttagctgccggataatcataagcggtcagcatgacaatcggttcttcagactccttcatttttagaaaatccagttttgttttcatgttttctcctcctcatgtttagaggagatgatctgccgttttcttctgcaagccaaaaaaccttccgttacaacgagaaggattcttcactttctaaagttcggcgagtttcatccctctgtcccagtccttttttggatcaaggcagactgctgcaatgtctatctattttaacaataggtgcagttcgcaggcgatactgcccaatggaagtataccaaaatcaacgggcttgtaccaacacattagcccaattcgatatcggcagagtagatttttttaatgccttcgttcgtttctaaaagcagaacgccttcatcatctatacctaacgccttaccgtaaaaggttccgtttaacgttctggctctcatattagtgctaataccgagcgcatagctttcccataaaagcttaatcggcgtaaatccgtgcgtcatataatcccggtaccgtttctcaaagcatagtaaaatatgctggatgacgccggcccgatcaattttttccccagcagcttggcagaggcttgtcgcgatgtccttcaattcatctggaaaatcattaggctgctggttaacgttaatgccgatcccaatgatcactgaacgtacgcgatcttcttcagcctgcatttccgttaggatgccaactgttttttttccgttaatcaaaatatcatttggccatttaatatccgtttggatgcctgctgcctcttctattccctgcacaacagctactgcagcaagaagagtcagctgcggtgttttttggagcggaatgtcaggccgcaaaatcaggctcatccaaacgccgtttccttcttgagaatgccataccctagacatccggccccttccggctgtttgtttgtcagccaccacgagggtgccttccggtgcgttattattcgcgagctcatgagccgttttttgcgtgcttgaaagaacgtcatggtaaataagatgctggcccatcacttccgtttttaatccaaaacgaatttcgctttcactgagttttccgggttttttgatgagccgatatccttttcttctaacggcttctacttcataaccctctttccgaagctcttcaatatgcttccacacagcagttcttgaacagccgagagcatcactgattttttggccggaaataaattcattgccggcctgagaaaataattcaataaggtcttttcttaatgttgaccgcatgtcttcagccactcctctatgtgtttcttttgattggagagcttccctgtcacaacagcctgctcgatccgctgtaattcttccgacacccattttccagccggccggtttcgaagcgcaagcaagtccttacccgtgatatcaagatccttaaggcttttgatcggcaggttttgataagcgtactgaatgtccttcagtttcttttcatccagtttttcgttttgccgaagctgcgatactttggccgctgagagcagtgctttttccccagctctgtacattgtcattgcgtcaaggctctggccaaacgtatcggcaatgtgaatggcttccttaatcacttttcccgggagcttccaacctttcaggaaaaggggcgcgtctttcaagactatgccaaggttaattaaaagagcagcccaaagctcctcacgggatgttaaagagaagaatggaaactcactcgttgaaatcaggttttctcgtttatgataaaaaccaggaagctcttcatacaatctcgtttgaatgagtgtttgaagcgcctggcgagaagctcttccctgcagcaatttctcgaactctatagtttttcgttcgactgaaacatgggagaggagtgatttttctttcgcaatggcttcttctgtttccggtgaaagcgtaaagccaagctggctcataaagcgtacggctctcagcatacgaagcgcatcctcttgaaatctatcctcaggctttccaacggttcgaatcactttctgatcaatatctttcttgccgccaaaataatcaagcaccttcccgtccgctgtcatggccatcgcattgatcgttaaatctctgcgttttagatcctcttctaatgatgagataaattgcacttctgacggtcttctgaaatcaacataatcagattcagtccggaatgtcgtgacttcataggtttcatcctcccagagcacaataatggtcccgtgctctttgcctacatcaacagtccgctgaaacagccgttctacttgatcaggtgccgcatctgtcgcgatatcgacatctccgatcgttcgtttcatatagctgtcacgaactgcgcctccgacaaaataagcctgatggcctgcttcgattaagatgcggagcacgggaagtgctttgataaaaactttttccatgtgatcactccggttctgctaaatcggcataaatctgttcatactggctgacaatttttttagaagaaaattcattttcaagcatctctattgccgcctttgtaaaacgattgcttagctgttcatcttctaaaatgctcatcgcgcgggctgttgcggccgtaacatcaccgacatccaccaaaaatccgctcacattgttttttataacctcagggataccgccaatgtttgttccaatacaaggcactccgcaagccatcgcttcaagcaggacaaggccaaagctttctttttcagatagcagcagcttcaaatcgctaatagaataaagctcttcaacacggtcttgatttccaagcattaagacttggtcttccaagccatattttctgataagctcgcaggctgtcgatttctccggaccgtctccgactaaaagcagcttcgctttcgttttgccagcgatattgcggaacacacggatgacatcctgcacgcgtttaacttttctgaagttggacacatggatgacgactttttcatctggtaaaattccatgtttctctttaattgccgctgtgtttttcttcagatacacgcgctcgtctataaagttataaatcgtttcaatttttttctccggtttaattaaatcgtacgtttcagccgcaagcgctgaggagacggccgtcaccctgtctgatgactcaatagcaaaacggatcagatcttttagagacggatcataacctaacaccgtgatatccgtgccatgcaaagtggtaacaatgccgatattgcgtttcagcatttgttttgcaagataggcgcaaacggcatgcgggagagcatagtgagcatggataatgtctaaattctcccgttccgccacctcagcgattttgcttgccaatgtcaaatcatacggaggatacttaaaaacagcatattgattaacctcaacttcatgaaaatgaatattgggatgatatgtattcagtctaaacggaatgcttgatgtgatgaaatggatttcatgtcccttttcagcaagctgcttccccagttctgtcgcaatgatacctgagcctccaacgctcggatagcatgtgattcctatttttagttttctcattgttcgcccccaagcacatcatgatcaagcatcagcatccgtttggaaaagaaaccttcggcatactccacgcccgcttctttaccgtaaagcttttctctcgcttcaacgatttcaatatacccattcgtcagaggagtagaaacggaatcctttgacgggataaactggcttttgtaggcgttgaggctttgtttctttgcctctattgtatccgagatatcaataacaaaatccggctgatgaaaaccatttatcatataatagtaaaccttgctgactttatgcgccggaaggcttttttcgtctttatatttatggattccggcggaaaagatcgcttcttccaccagtgcagccgcattggcgtgatccggatggcgatcctttttatacggcataaaaaccgcttttggccgacagattctgatgacagtgacaattgaccgaattgcctgatcactcattattaggccgcggtctggaagcgttagctgaattcttttatctgcgcctaatatgcgggctgcttcagctgcttcttctttacgcaaactgaccgtaccgttagaagagagttccgcttctgtcaaatcgcatatcattacttttttttcctgtttgacaaacttcgctattgtgccgcccattccgatctcgacatcatcactgtgggcgccaaaagcaagaacgtcagcattatacattcggctcttctccccgaagaaggtcacggaattcgaaaacaccttcatcaagtgtgcgcacaagaatttccgcagtacccatatttgtggcgagcggaatggaatacacatcacataaacggattaatgccgagacatccggttcatgcggctgcgcggtcagcgggtcgcgcaaaaaaatgacaagatcgagtgcattggcagcgatcagtgcaccgatttgctggtctccccctaaagggccggattgaaaacgttcaatttgaagacctgtcgcctcatgaattttcaaccctgtggttccggttgcgtatagatcatgattctttaaaatatcccgataggcagtcgtaaattgaaccatatcctgttttttcttgtcatgcgcgatcaaagcaattttcattgtttatccccccgtctaatcaatgatattttctaaaccatacacaagctgatcaatcttcatgacttgttcgactgacagtttaacgcctgacatgaaagaagcacggttataagaatcatggcgtatctgaagcgtttggccatccatgccgaacatgacctcctgatgcgcgatcagtcccggaagacggacgctgtgcaagcgaataccgttttgctccgctcctcttgctcctgggagaatttctttttcatccggatgtccttgctgcttttctttacggacttctgaaatcatttccgctgttttaagcgcagttccgcttggtgcgtcaagcttctggtcatgatgaagctcaataatctcaacatcctcaaaatagttggcagccatttttgaaaatttcatcatcagtatcgcaccgagcgcaaaatttggcgcgatgatggctccgatccctttttcttctgttaaagatgtgagctcttttaaatcagcttctgagaaaccggttgttccgacaactggacggactccgtgctctaatgcaatttttgtatgtacttttccgatttcgggcgttgttaaatcaatcaagacatccggttgtgtttctgtaaaacaggcatggatatctgtataaatgaaagcatctgactcaacaggcatcacatcagataatttttgctgatcgtatgtatggtctatggccccgacaaggtcaaaatgaggtgttcgttctgccaatttaacagcttcctgccccattcttccacgcggtcccgcaatgactactttaattgtttcgtttgacatctcgatctcctctactttccttcttcttttctggtccagcgatctttatctcttgtattaaatttatgcatgactcggtcgtgggcttcctctaaagagatatcaagggagttggctaaacaaaccaatacaaatagcacatcgcccatttcctcttccatgcttttatcatcttcagtcgctttttttggtttttctccataacggtgattcacttctctggcaagctcgcccagttcttcagtcagcctcgccatcatggccagcgggctgaaatatccttctttaaattggccgatgtaacagtctacttcagcctgtatgtctttcattgttttatcactcactgaacgaaacctcctatcatcctcttacatgttagctaattcagatacgtttgacaaatgtttaagcacgtttgctgttttctttttcatccactataatataaacgctatctaatggaaggaaaaggggttttatgtgatgcttggagaaattagattaaaaaacatattttttattttaatcggagcggcaattttttcatttggcttggttcatttcaatatgcagaacaatctggctgagggcggttttacaggtattacacttttgctttatgcccttttccacatcagcccctctatatcgaacctggtgttgaacattccgattttttttattggctggcgtttgctcggcaggacaatgtttgtttatacccttgtcggcactgtagccttgtctttgttcctcagcatctttcagcgatatgaaatccatatgccccttcagcacgacttagcgctcgccgctttatttgccggcgtattcatcggagccggcctgggaattatttttaagttcggcggtacgacaggcggtgttgatatcatcgcacgtttagtgaataagtattttgggatcccgatgggcagaacgatgtttgctttcgatgcctgcgtcatcattttgtctttgcttacttatctctcctataaagaagcgatgtatacgctggtagctgtatttgtagcggcaagattaatcgattttattcaggaaggcggatacgctgctaaaggcgctacgatcatctcttcgaaaaacgacctgattcagaaaaagattcttgaagaaatggaacggggcgtcaccattttgaaaggacaaggctcctacacaaaagaggatatagatgtactttattgtgtggtgccgaaaaacgaattggtgatgctgaaaagcgtgattaactccattgatccccatgcctttgtagcggtaagcgatgttcacgatgtgctcggagaaggatttacgcttgatgaaaataaaaatccgcttccgcgctgacatgtaatagaaaaaaggcggctgaccgccgcccctcacccttatttagggtagtccctttttttcagcttgtttttttccgccttgtactttctgtaaccgacataggtaagagcagtaatgatgatactgccggttgtaatcatcacccagagtaaagacggatcggcatcatcctcctccaccctgtcaaacacatttttcaggtcatgctgaagaagggaaagccgttcaagcttcgtgctctctgtcatttgctgaaattcctcttgctcaataacatctatatgttttccgactgtttcaagctgatcctctgatacatcgattgtaagactggggtaaatcaagtcatataaactgataaattcattccatttttcatgaaagcttatgcttccattcttctggacatctcgcttcagctcagtaaaagcttccataatcggtttttccagtgagccccaaagcgggtcagaccgattgtcaaccgcatccatcagcattctgaactgcgcggctgctctgagtttttgtgtgtctgatgtatcagcttgctttaaactccgaaccatatcattatagcccaatgtgatttgacgaatttgggctcccgttagcatggggtcttgctgttttttctcagcggattttaatgttttttcaaaatactccaagacttgaagcgcctcttcatatttcgcctgtcgggtcatttgaaagactgtatcggataaatcattcaattcctcgaggcttccccgctctgcagccttggcatttccattataaaaaataagtgcaatcaacaaacagatcgtcagctttcgtttcatgcaggtccctcccactctctctccttacagaatatgaagaaagggacaaggatagaccaacattgtctttacatcagctcaagcttcgtttgtttttttgagaccacaagaaagtaagcaagcgcgattgaaaagatgcttagccaaaatgttccgtatcctatttcagtcatataatcagaaagcatagagtattgcggcatcatatcaaacaagtagtcaatgacatcgttatgcagtgtccagactgcagcaattgcaagatgccaaaatgaaaaacgaaaatacggactgtataatacgccttgaactgccattgcaaaatgcgaagcaattagcatgtagccctcccacggcaagtcaccagttactgcaagcacaagaaaattcatagccaccgcccataggccatactttacgagggtaactagcgcaagcgcctcaaagaacggagcattccgtttcatgagaaaggcaagcagcacaaacagaaagaaaaacgttgctgtcggactgtccggaacaaaaatcaggaaacgtgccggtgtctccaaaagctgcggcaagtaccaatagtagccgtaaaccgttcccagaaaattaatggctaagacaagaataagcatcggccgctgccctaatacatattgaaaccatttcacatcgaatcaactctcagtctgtaaaaataatatgtccaaataaaaaagctgacgccgggtcagcttttgataataaaagtatatccttccatttgacaattcacaatacgttattttgcggttgtttcagaaataaattttgcaagttcttcgagctgcttatcatttcctttgaacacacccgccggcattttgcctttcccttctacagcgatttttttgatttcatccggtttcagcccgctgtcaaccaatgaaggcccggccgctcctccctgaaggttatccccatggcaagaaatacagccctgttccttaaaaaccttatatccttctgcattggtgtcaatgtcggcttcttttgtaattttcccctgttcttctgccttggcccagtcatgagtagcaactgactgccacgtcaaaaatacagcagcggaaatggccagaagcatcataccgacagcgaccggacgcttccacggccttctttctgtccctctgtctaggaatggagccaaaagcagggccccaaaagcgagacctggcataatcatggcgccgaccactgtaaagcttccggcggcgtattcatacttcaacagctggtataagaaaagaaaataccaatccggcagcggaatatacccagtatcagtcgggtccgccatccgctccaaaggcggctgatgcacaatcgtcaaaacgagaaaaccgatgagaaagacagctccaaccatccattcctttaacaagaaatttggccagaaagcctctgttttacccggatactccgaataatccttcggtatattcggctttttttcagccggtatccttgagtcgcctacaaatttcatccctttgccccggtgcatgtcatcccctcccttttattcgcagatcaagagtttaaagcggtcctgaaatcccctgcttccggatcataataaaatgtgcagccatcagcccgaacaatgcggcaggaagaaaaaatacatggatcgcaaaaaacctagtcagcgtttgggcgcctacaatatccggatgccctgcaaggagcgttttaacttgcgttccgatcaaaggcgtagcttcggcgatctgcagcccgacttttgttgcaaacagagccttcatatcccaaggaagcaagtagcctgtaaagccaagaccgagcataacaaaaaagatcagcacaccgacaatccagttcagctcgcgcggttttttatacgcgccttggaaaaagaccctcagcgtatgtaaaaacatcatcacaatgaccaggctcgcaccccagtggtgcatccccctgacaatctggccgaatgccacttcattttgcaaataatataccgattcccaggcatttttgatatcaggcacataatacatcgttaaaaacattccagataatacttggataacggttacaaaaaacgtcagtcccccaaagcaatacacaaacgcagagaaatgatgggcgggattcacatgttccggtacttcgtgatcggcaatatccctccacatcggtgtaatatcaagccgctcgtctacccagtcataaattttgttcagcatgtcacccttcccccttaggctttgcttttccaagatacaggaagccgtcttttacttcttgctcataatgatcaagaggcgcaagcggcggcgtgccagggacattggtgccgtccttttcatagagtccgtaatggcatggacaaaagaatttattcgggtttttaggatcactattccagttcaccgtacaccctaaatgtttacaaattggcgaaagtgctacaatttcatccccgtttttgaagacccaggctgatcttgactcttctgactcataccaggcatcgacttgattaattttaaaatcaaagcgctgcggctcttttgtcaactcatcaacgctgacaacctgaaccatatcctgcttccctgtcgattttaataccgggtcgagtgcgaagcgaaccataggcatgagcatactagccgccataaaacctcctacacctgtgagcgtgtaattcaaaaattgacgtctggatatatcatgttttccgcccatctcttctcccccctctaggtcacccctgcaaactgactaaaatagaaaatattgcaataactctagacaccctcataatatatgaatctctcagcaaggtcaatatagccaaaatattgtttataaggaaatgtaagtgtttttatgaagtgctccataactgtaacaaaacgttcaaaatttcagcagtgcgttcatccaatatttttcttattaaagagtcatttaaatgctctaatggaacagacggtgtaacaatgattttgcctaacgcatcctcagctctccaactttcgtcagatgtgagcaggacaacatgcggaaattccgttatcagctcttcccgcaaatccttaagcccttgaacggttatttcatttctatcaacatatgtataaggcggaagtaaatatacccgtccctttaactgcctttcaagttcttctgagagaagctgcgtaaactcgcctttctccgccgccattttaaaatggttattaacccttatgttaattaatggtatgacagcggtatcaatgtaatccttagcttgtaaatagtccttggcatcagtgattctccacctcatcgttctccccctttacggcaacaagccttgcaattcactgcaaggctggtcatattatgtgagctgatttaattggcgcgataattgttcaaatgcctctttatcatgacgatctaacgcctcgtcaatgtcttttaataatttttctctttggaatgtggaaatagcgtgctctaaaatctgttccgccaatccctgatcttttttattctcaaaaaggtttttcggaatatgcgggttggactccagcaccgccgcatattcaggtgagctgtaagccgaacggaaattaagctggataaacaaatcctgctgtttatttaatctaatatcatgaaaagatttttccgcgtcggtagtcatgacattctctttatagaaccggaacggaacttcttcaacacaatgtgttgacattataatgcctctcgggcaaaattcagcctgctccacaaaatgaaccttctccatgagagaatcatggctcattaagtagttcaagatccaaacgcactctcggcgctttaactgataatggtttaaaaaccaacggataaaatcttttttctcattgacagaaacaggggtctgcatgtaattccctcctctatcgttcgtataatctatatacttatatgttccacatgaatggttaatattcctgcttatctagaaaattcatcctcgattcgcaaaatcgtttcttcaagctcttcattggctccgtccatttcaagaacctttttcaaaagcggcagcgcttctttttgaagaccttcttctaataggaagcttgcgtattcatataagaaatctctatcctcccggtaatgaagataggcagcctcaaaggattgttttgcttcctcgtattgctctaattcagtatatgcgcttgcaagataccaattgtatttaggatcttcttcaccgtagcttcgaacctcttgaataagatcaatgatctgatcataatcctcttctttgtgatacacggcaagaagtgtatgaagcgcctcgacaaagcccggatcaagcgcaagcgcctcctgaagcagcttcttcccctcttctgacttcccgattttcaaggccattttggcggcataaaggaaaagttctttgttatattcatcatatctgatcccctcttttgccgtttttaatgcctcttcatacattccttcagcttcatagcttttcgagagcggcatataaagtgaagtataagatggatcaagctcctttaaatcagacagctgcttaatagctgttttcacaagccccgcctgtaaggctgtaaaaccatagccgaaaatcgtattaggatcaggattctcatcgacagctttctcataccatggaatggcatcctcaaattcacctgaggcacttaacgattctgccagtctttgatggacattaacgcccccgatctcactctgctcctcagccgttgttttaaaatattgaaccgcttttgcataggctccctgagcaaagtaaagttctcccagtgcaaaatcaataacaggttcattgtccagaatggactttgcctggaaaagcttttgttcactgacttcgaataacccctgcatctgataaagatccgccataagcagcaaactttccggatatgatggatctgtttccggaatagtctccagcacagcgagggctttttcttcttcgtcaatatctattaaaagttcagcgtagaaattcgtcagttctgtttcatttggatataaatcatgtagatcactaatcagtgaaatggctttttctacatcgccccactcgtaataaagctgggctgcaatggctttatcttcatcatgcagctgtttttcagccttcgagagcgtgttgaggcctttttctgtttcacctgcttcaactaattttatggcttcttgaatcaatgtattcaaatcggaccggtcctttcttttcctatacaacatcaaccatacaaaaaagctttatttgttcgggttaatcttatcataattcagacgaatgcccccggcaaataagatgcttctgtacggaagggaattattgagtcttattagtttaccaaaagatcttgagatagaaaatgaaaaaaggaagatcgccctctgtacagtaaagcagctctttgacctgccggcttgtaagtaaagcacatcccccttttcgtttttctatcccctctataagacaagctatgttttttcgcctcgaattatgatctgcataaaaaatcctgaagtaaaacttcaggattttttcgaaagcttatttaaatgctcgaagaaggttggataagaaacgtgaatggcatccgtgtgctcgatttcaatcggctcctccgttatacaggaagcaataccaagcatcattccgattcgatgatctccgtggctggacactgccgcgccgcctttcaacgtttgtttgccataaaccttcattccatctgctgtcggttcaatttcagcacccagcttgcgaagctcagaaacaacagtatcaatacggtttgtttctttcacttttagctctgccgcgtccttgataacggtagttccttcagcctgagtcgcaagaagcgcgatgatagggatctcatcaattaaacgcggaatgatatctcctccgatttcaactgcctttagagatgacgtttctataatcaaatctccataaggctctgcaccgctatcagcagatggtttgatttcaagttttgcccccatgttttgaaggacatcaataatacctgtccgagtcggatttaaacctacgtttttcaatacaattctgctgtttggaaccatcgcgccagcagcaaggaaaaacgcggctgaagaaatgtctccaggaacaaaaatatcagcagctgtcagtttctggccaccagcaatggaaacactcgtttgatcttcagaaagcttaacgccaaaagcagaaagcatccgctcagtgtggtcccgagatttatggggctctgttacagttgttgtgccctcagcctgtaatccggccagcaaaacagcagatttaatttgcgcgcttgcaacaggtgatacataatcaattccttttaatgaagcgccgctcactgacagcggtgtaaactctccgccggctctgccgtcgattttagcccccatttttttcaaaggctcagtcacacgcttcattgggcgcttcgcaatgctctcatctccggctaccgcgctgtaaaaaggacggcccgccaatattccgagcatcaggcgaatggttgtacctgaatttccgacatctaaaaggctttctggctctttcagggcatcgattccttttccgtgaatcacgacatcgctgctgctttgctcaatgtgaacacccatttttctaaagcaatcgatcgtgctcagacaatctgctcccggcagaaagtttttaactgttgttgtgcctgccgctagcgcgccaaacataacagagcggtgagaaatggatttatcaccgggaatatgtatttctccatgtaaggtctgcaccttttctcgtttcattttttccacctcaatcagcataaaaagtttcatattccgcccgggcttcaatgcattgttctgcccttttgcggtcgtcatcagactgaaaactgatccttaaaatcccgttaatatcctctcgtgtttcgataatgcggatattcgtgatactgatgcgctccgcagctaagatcgctgttatctcggatattacacccggatgatcgggtacatccacatataaatcataaaatgcaggtatcgctcccttctgccgaagcggcagcccgtcgcgataatccttggcggttttaaaataacgaaatagattttccgcatcttcttgttctacatatgtacggatcttgtcaatttcacgaatccactcatcaaaacggtctaagattttatctttattatgtaataaaatatcccgccacattgccgggctgcttgatgcaatccttgtaatatctctgaatccgccggcagcaaaacgcttaacaagcggatacaggttttccgaatgatgggtttggtgaacaagactagctgctacaatatgcggaaaatgactgattacacttgtaacgccatcatgctcctccggcgacatttccacaaaatgggcattcgtacccttcagcagattttttaactgttccacagcttgtttgtctgttttctggcctggggttaaaatataaaatgcattttcaaacaggaactccttcgcagcggccactcctgatttatgtgaacccgccatcggatgccctccgacaaattgatagcggctaggcagcacttgatcagcgtaatcaaccactttttgctttgtgcttcctacatccgtaatcaaaagctcatgttcaattcctgaatgagccagcgcttcaagcataaccagtgtttgttcaacaggtgtcgcaatgattactgtagctgcctctttcgcaccgctaataaacgaatcagcacgatcgtctatcacgcctaattttaatgccgctaccgcctgttcatcagagatatcgattccgataatccgtttgccgggatgattttttttgatggctagggctatcgaaccgcctatcaatccgagaccggcgagcaatattgtatctttcatttgattcatacgtcatcacctggtttatagactaaagaggtgatattcgatcacctcttataaaatttcagctaaaatggcaagtatttcttcattttgctcttttgttccgatcgtaatccggagtgatgtcgggaaacctaatgcatttcctgaccggacgatatagcctttttccagcagagcctgaaacagttcatcagcaggacgtttaaagtcaattaacacaaaatttgtctgtgaagggtagcactttaaaccatgagttttcgcaaaatcataatactgctgaaggcctgcattattttgctcgacacaggaagcaataaacacttgatcatcaagtgcggcaatcgccgcagcctggcccagacggctcgtattaaacggctctctcgccggctcaatctggcgaatcaggttctcgtcagcaattccgtatccgactctgagcgctgccagaccgtatgcctttgaaaatgtgcgcaaaatcatcaaattggaatacttgcttaagagcggcacggtttccgggtaatcctctgctgttacatattcataatatgcttcgtcaagaacaacaaggacacgtgaaggaacgcgctccagaaatgcgagtaattctccttcagatgtataagtgccagtcggattattcgggctgcatatccaaacgacttgtgtctgttcgtcgatggcttctaacatggcgtctaaatcatgtgagccgtcgggacgaagtgcaatttcacgcacttcagcaccttcaataaccgcattatgtttatattgcggaaaagtcggggcagcagtgatcgtattggttttattgtttagaaatgcccggcagatgatctgaatgatttcatcagaaccgttgccgaaaataagtgatgtttcgctgacattgaggtgcttactgagccttgtccgcaaagcggcgctatacccgtccgggtaaagggctagctgttgaatctcatgatgaagcgcctcttttgcagcctctgaacagccgtaaggattctcgtttgaagcaagcttcacaactttatccaagccatattctgatttcactgcttcaatcggctttccaggctgataaggcttcagctgttttaaatgttctttgatacgcaaatcagtcacctcattttaaactgtacaagccgctaaacgccattgcataatcctcaaactcctgcagcgcctgatttctcgtttcagcgctgatgagccggtcctttaattcttctatttttctgacgagcgcacttcccactacgacaccgtcactaatttcattcatctttatgacctgttcacggtttgatataccgaaccctacagcgaccggaacagtgctgagattcttcactgtccgaatgaacgggtacacggatgaattgaactcattgcggacaccggtcacacccagagaagacacacagtagacgaagccctcggcttgttcaataatggttttcaaacggctttcgcttgtcggcgcaaccaaagaaatatacgtcacctcatggcttttacattcctcttgaaggctgttgctttcttctagtggcagatccggaacaagcagaccgtcaatatgattttcccgcagtaaagcgaaaaagtattctttgttcaattgtaacacaggattataatacgtaaagaggataatcggaatattcactccgttttttttcatttctccgcctaattcgattgcctttacgatattcattccttgatcaagtgcccgctttgaagcccgctggatcaccggaccgtctgcaagcgggtcagagtatgcaacaccaagctccaatgctgtggcgcctgctttttggagtgacttcgccagttcaatcgaaacctcaggaactggatcgcccaccgtaataaacgggataaacaatttttctgatggttgaagatcaaatttaaacatgggctttcacctcttcttccaatacattcattaatgtgttgacatccttgtctccccggcctgataaacagacgagaatgagttgaccgcgatccattcctttggcgagtttgaatgctttcgctaacgcatgggcagattcgattgccggcaaaatcccctctttttctgacaaaagctttaatgcatccaccgcttcttcatcagtgatactgtcataagtgacacggccgcttttatgcaagtatgcatgctccggaccgattccaggatagtcgagaccggctgaaatagagtagggctcaataatttgcccgaactcatcctgaatgagataagtcaatgaaccatgaataacccctacggttcctttcgaaatagtggcggcatgaagaggcgtatcaattccttttcctgctgcttcagcgccgatcagttcaacatcttcatttaaaaatgcctgaaacatacccatcgcattgcttcctccgcctacacatgccactactttatcaggcagagtgccttcaatacgtttcaactgatccttcgcttcctctccgatcattttttgaaattcacggaccacttgcggataaggatgcgggccgacaactgatccaatcatataaaagtgatcctcacaatgctgaacccagtaccggatcgcctcatttgtggcatccttcaatgttccgtttccgcttgttacaggcactacctccgctccaagaagcttcatgcggaaaacgttcagagactggcgggcaacatcctcttcacccataaacacagtacaggaaaagccgaatttggctgcaactgttgcagcggcaacaccatgctggccggcaccggtttcagcaatgattttcgttttgcccatttttttagcaagcagcgcttgacctagcgcattattgattttatgagaacctgtatggtttaaatcttctcgtttcaaatagattttcgcgccgcctaagtattcagtgactcgatcagcgtatgttaatgcagtcggccgtccggaatagtcctttaacagcttataatactcttcacgaaaagcggggtcatccttgatttgtttaaatgctgtttctatttcatctaacggctgcatgagtgtttccggaacaaactttcctccaaaatcaccgtatctgcctatttcattcggatatggatacatatcggttcatcctttcttctaaaagcctcatcagattctgatctttttgtccgtttttttcaattccgctggcaaggtcaattccttctggctgccatttcaataggctggtgatgctatccggattcacgccgccagcgataaagcagcgtttaccaatagccgcctgctgatattccggcacacattcccaagaaaatgcaacaccagttccgcctctagacccttttacagatgaatcaatcacaaagccgtcaacattatctttaaagcgggctatttcttgagttgtgttaccttgatggtgaagcgccttccatatttcacagcctgtcagcttgcgaagagcagcagcatccgccggtttttcatcaccgtgaagctgaatgacgtcgagcttcaagctcttggcaatacgtgacatcgtctctattgattcattaacaaaaacacctgcaacctgtttttcgacacgagcttggttcagccattttttcacatcttgcggagatacttttcgtttgctttcagcaaaaataaatcctaggtaatcagcctgtgattccgccgcaagctgcaaatcctttagtgaccgaataccgcaatattttaatgccggtttcttcacaacctcactccccaaacaaagcatggattgctttacgctgagaagtttgtctcatcaatgattcaccaataagtacagctcgcgccccatgttcattgacaaatgttaaatgttctaaagaaccgattccgctttcgctgacaagcaaggattctttcggaacgagagatgcgatttgttctgtctgctttacagatgtttcaaacgtttttaggtttcgattatttacgccgagaatgtcgggtgtgaacactttcaatatttgttctagcgttgatgcatcatgaacctccactaacacgtccatccccttttcacctgcttcaagatataattcatgaaggtgtaagggatcaagcacctcgccgattaacaatatggcatccgctccgattcttcttgattcctctacttgaagagaatcaataataaaatcttttctaagtacaggaatcgaaacagcacgctttacgtctgataaatagctgttttccccttgaaaaaacggggtgtctgttaaaacggaaatcgcatctgccttcgcagcctcatagtcttttgcaatctgcacaggcacaaaattctctttaataagcccttttgacggcgatgctttcttcacttcggcaatcaacccgataaaccgattcgggcttgccagcgcctccttaaatgaacgtttctcgaaaggctgctctaccggcaaaaccagtgttttcacttcttctttcttttgtttgatgattttttcaagcatagatctcttcctctttctgctttagtcgttcaagctgcgcggcagcgcctccgcttgtaatcgtctctaacgccagctccgttccttccttcagtgaggcggtaatccccgccgtgtaaatcgcagctcccgcattaaaagccgtaatagataaagcggaactgctgcttttattttcaaaaatattctgaatgagataggcgctctctttcggtgactgcacctgtaaatcttcaagtctgccatttgtgaaaccgaaatcttcgggtgaaacggtatattcccggcgctctccgtcctttaattcaatcacgtcggtcggtgctgtaattgaaagctcatctaaaccgtcacggcttgatacaaacatgacgtgcttcggctgaaacgtctccagtgcgcttgccatcagtccagctttttcaacagaatagaccccaatcacctgacgcttcgcctgtaaaggattgctgagcggcccaagcagattaaataccgttctgaaacctagctcttttctagtacctgctacatgtttcatagacgaatggtaaagcggcgcaaaaagaaatcccatgttgtttgtttcaatgctgcttttgaccttctcgggagtggtttgaatagaaacctctagctcctctaaaacatcagcgcttccgcttttagaagagacagagcgattgccatgcttagcgattttcgcgccagctgccgaggcaacaattgccgaggcagttgagatattaaaagtggaaataccgtctccccctgttccgcatgtatcaacaatatcaggaagtccatcgactgtaagagcgtgtgcccgcattgccttcacaaaacccgcaagctcttctggcgtctccccccgatgagcaagaatagacaatataccacccatttccgaaggagtcatttccgctgccatcatcatattcatcaacgtttcagcctcaccggcagtaaggttttttccgtcaacgcacaattgaagaaatttgttcatcagctttatcctccttgctatgaaacatgtcttctgcaatatgaatcgttttcagcagcgcaccggctttattacagctttcttcgtattcggcttctggaacagaatcagcaacaatgccagcacctgcctgtatcgatgcaacgccgttctttacactcatcgtgcgaatcgtaatacaagagtcgatattcccgtcaaacccaatgtaggcaatacaccctccgtatgtctctctcggtgttggctcgagctcttgcaaaagctgcatggcacggattttgggtgcgcctgttaaagtccccgccgggaaagcagacatcagtgcatcgacaggatgaaccccttttttcaatcggcctgtaaccaccgagataatgtgcatgacatgtgaaaaggagacaatttttgtgaactccggcacagaaacagaaccatactctgctactctgccgatatcgtttcgggcaagatcaacgagcatgtaatgctccgccttttctttttcatccttcatcagctcaaccttcagtctctcatcttcagctttgtctgcgccgcgttttctcgtaccggcaatcggatggatttctaagtgcccgtcttgaacgtgtattaaccgttccggagagctgccgactatttctctgtctagcagtttcatataatacatatacggcgaaggattgacgatcctaagcactcggtataactcaaaagcatctgcttttatcggcacctcaaatttttgtgataaaacaccctggaagatatctcctgcttttatatagcttttgattttttctacatcagccataaaagccgatttttcataattagaagataccgtctcaaagctgggtgtcttgtatgaatcagcagagagaaacagctcttttatttttttttggtccatcattttttcgatgagattttggagctccaaatgattttgatggaatacatccattttttcgttttctgtttcctctccagtgagccttgcatattggataaagtggacgtttttggtttcatgatcatacgcaattaatgtccggcaaacaaacagcatgcacttttccatgtctgtttcttttgtatgcgaaggaacagaaggctcaatcagcgggatcatatcatagcttaagtacccgacagctccgccgacaaaaggaatgccaagctgaggtgttttgattttgtatgtggtattcatccagttcagcacttcttttagttcatttcctgtgtaaagagatttgctgtcctgatcagcggccgaaaaacggccctgctcttctttaattgtgagaaatggatgcaggccgataaatgaatatctggaccaagtggatgtatcgtcctggctttcaagaagatacgtaatctccctgtcaagcttctctatcatttgaatgggtgtcagtgtatcgactgtgaaggtctccacaatcggtatcgtgtggtgggacaagctgtcctctaaaaatgcggaaatgtttgattggaaattcattactctcactccttatggcaaggagaatgagaagatggcatgagaggataaaatactatataacaaataaacccaaaagaaagacttcttttgggtagaataaacataatgtctcagctcaactaaactcattctctgctaccctattctctaactcaactcattctaattgctttatacacactcttgtgtatttctaagctgttcttatcgtattacaattcagtattttttgtcaatgataaatcgggcctcaatacgacggctttttctaaatatacatgtctgatctgatcctgagggacatctgtctggaccgtcatcatgactcttatgcactttttcagaccgcctgttacgtccatttcctgcatacatgttaccggtacatactgccatcctgaaagctcgcgaacagcttttgccgggaaaacagcgtgcaaatcaggtgtagccgacagaagcatttgaacaacatcttccggttttgtatgattttcttctatgattttctctaacagctgtttagttttttgtaaaatttcttcttcagtatcccgttcaactgtagttgctccgcgaattccgcgaatcatcatgatgtctcctccaatcgccatttgttcagccagctctcaagttcatttctggaaaatgtatgatcagcaactttccctaattcgttgagcacaataaactgaatcttcccgccacgggttttcttatcattcatcatacggtccaagagaaccgaagtttccgtctcttttctgatttgacttggataacccaggctttttagccagctgaccaaacgttttctgtccatttcacagcctacagtcttttcgcttatatataaagcaaactgcattccgagggctacggcatcaccgtgagtgatctgcccgtatccatattccgcctcaacggcatgaccgagcgtatgcccgaagtttaagtaagctcttatcccctcttctttttcatcctgctgaacgacagacgctttaattgaaatgcctttaaaaatcatgtcattcagctgatcattagtgatatcacgcagtgagtggatattcagcaactcctccagaaacgctctgtcatagataaaagcgtgtttaatcacttctgccattccggacctaagctctttttcaggcagagaacgcaggaaatctgtatcatagagcacggctttcggctgataaaacgcaccgattagattttttccaagcggatggttcacggctacttttcctccgactgcgctgtcatgcgccaagagcgtcgtaggcatttggatgaaatcaatgccgcgcataaaagtggcagccacaaaaccggcaagatcccctacaacaccgccaccgaatgcgatgatgcatgaggagcgatccaaatgaaaacgaatcgcttcactctgcaattttgtgtacatgtccatggattttgcctgctctccactcggtaccgtcacttttttcacaggccatttatcttgcagcaaatggagcatttcatcaccatacaggcggtccacttcttcatccgtgacaagcataatccttgttaaaggcctgtttaaagaggttaatagttcgcaagccttttttctgataccttgtccgataaaaacaggatatgacgaggaagcagtttgaacatgcagtgtcttcattaaaattccctcgacagttttctcatattctccacattttctctaatgcggtcaatttgatctaatccgaattgttcaacgactgcgttcgcaatttcccaagcgacagccgcttcagcgactacacttgccgcaggaacagcacagctgtctgaacgttcaatgctggcagaaaacggttctttcgtttcaatatcgacacttttcagcggtttatacaaagtcggaatcggcttcatgactccgcggacaacgattggcatccctgtcgtcatgccgccttccagtccgccaagtctgttagtagcacgggtgtatcctttttcctcgtcccaaatgatctcgtcatggacttcgcttccatttcggcctgccgcctcaaatccgatcccgaattccacacctttaaatgcattaattgacagtacagcggcagcaagcttgctatccagtttgcggtcataatggacatagctgcccacgcctaccggcattccctcgacaatgacttctactattccgccgatggaatctccgtttgcctttgcttcatcaatggcagccatcatttttttgcctgcctcttcatcgtagcatctgacaggagactcttccgttacgcgctgcaggtcttcaattgacgtatattctgttttttcagctttaacagcgccaatttgcaacacgtggcccgccaccttaatgccaagctcagaaagaatctttttagctacagcccctgccgccactctgacagttgtttcccttgctgaagaccgctcaagcacatttctcatatcacgatgattatatttaattgcaccgtttaagtcagcgtgcccaggtctaggtctggaaatctggcgcttcatttccttttcttcatcttctgtaattggagcggcgcccatgatttttgtccaatgcttccaatcgttattttcaactacgagagcaattggtgaaccgagtgtacgtgcatggcgcaccccgctcataattttggcctggtctttttcgatctgcatgcggcgaccgcggccgtgtcctttttggcgtctggcaagctcaaaattgatatcttcctccgttatgtaaagcccggcaggtacaccctcaataatggttgtcagttgggggccgtgtgattctccggctgttaaatatctcatgacttcttctcccttcatcacattaacgcttttaagtaagactactataacatatttttcagcaaaaagtcagtctatcttttttgataaaagaatgtatcggctgggactaggccaaatttctcgggattgaagatttgctcggtgctgccgacaaaaagaactccattcttcttcaagctatgtgccatttttaaatacagctcttccttcgcgctttctgtaaaataaataaatacattgcggcacacgattaagtcaaagtcttgttcataacgatccgccagcaaattgtgctttttgaatgtaatattctttttgatttccgttttcacttcataacttctatttgcgttttgcgtaaaataacgatctttcacagatagcggcacttcctgtaaagaccgctcctgataaacgccttttttggctttttccaaagctttttcatcaatatccgtcgccaaaatctgatagcccggaagacctttttgctggtccaaaagcatggcaagcgtgtatggctcctcacccgttgagcaggcggcactccaaatctttaaaggcctagaggtcttgattaacggcagaattgcagtctcaagaacttcccatcttttataattacgataaaattctgaaacattgatcgtcattctgtccaatgtttcatttaagagagcttgatccttttccaatgccgccgcaaagtccttaaagctttggaacccctttttctcataaagtgacgttagccttctcttcatttgtgcttctttatatagtgtcaaatcgactccggttaattgtttccattttgttgtaaatacgctgtatgtatccatctctactctcccagtctcgctgtctttttgtcctagtatagcttgttttatcaggaaattgtattgtttcaataaaaaaatcagcttttcagctgattttagatcgttgggaaaggcagaggtctgatgcacactgccaatcaaccctttattcactttaatgtaaacctttacaaaacagatcaaaaaccggcggcgttatatgttgccggctctgttgcttattttcacaatgattaatagatccagcctgccataagctgctgatatgatactaattcttcattcttaaagaaaatgttaatctcgcgttctgcactttcgagagaatcagagccgtggatgatgttttttccgacaaacatgccataatccccacgaatcgtaccaggtaaagcttctttagggtttgttttcccgatcagctgtctcgtcacttcaatgacattttcgccttcccacaccattgcgaatacaggtcctgaagtaataaactcaacgagctctccgaagaaaggcttaccttgatgttcggcgtagtgtttctcagccatttgttcagtcactctcattaacttggcgccagctaattgtaagcccttacgttcgaatctagataaaatgtccccaatgagctgacgttggacaccgtctggtttcaccatgataaaagtcttttccatcatattctccaccccatcattatgtatgtataggctttcacactgcacaccgaaatcgtaacatctttctgataattaatcaatccggggcggagaaatttcttaatatctacaaaaattaaaattttcttttaccgatatattttgcgatggctgcaagagacgagcgtgcgcgccctcgaggaagcgtgtttaatttctgaaaagctttctgcagatacatttcgcttactgccatagatgcttcaattgcatctgtttttttgatttcttcaatgattggttcaagctgttcctgcgttgtctcactgttaatcaatttaagctggttttttaatgcaggatttttcagggcatacagcactggcaatgtgacgtttccttgaagcaaatctcctcctacgggtttacccagctcttcctcagttgaagtaaaatcaagaatatcatcaataatctgataagacatgccgacgtaatacccaaaccagtacaatgccttatgaatcttctcatcagctccagacgcaatggcaccaagctggcagctgaccgcgatcaagagagctgtttttcttttgatacggcggagatacgttctgagattttgttccatgttgtatttgtctttgatctgctcaatttcccctagacaaacttcaacgatcgtctgtgacaaaatcctatgggctttcggttcgttaattctcgtcatcatttcaagagatcccgcaagcatataatcgcctgtgtacatcgcaatacgattgtcccactttgctttgattgtcggttttcctcggcgaagctctgcatcatcaatgacatcatcatgaaccaaagatgccatgtgaatcatttccagagtgacggcgacatatttaatcttattaatatcgtaatcgccaaacatgccagaaagcagcacgaaaacaggccgaatacgtttccctccggcctgcagcaggtgaagacctgcctcgcttaaaagcgggtaatcggaacgtacggtttgttcaagttctctttcgattacatcaatatcgtcatttaaaaaagagtaggccattttaaatttcatatcattcacccaaacatctgtgttttcatttccatccgatatgcgtggcagcgactccgccagtaaacgaatgatatttaacatttttcaggcccgcctcttcaaacaggcctgccagttccttcattccagggaaatctctggctgattcttgaagccaagaatattctttatagctcttcgcaaacagtttcccgaaaaacggcataatatacttaaagtacataaagtaagcctgtctgaatccgaacatttccggctgggacgtttccagacataccacctgcccacccggcttcactacacgtctcatctctttcagtacagtcaagtaatcagggacattgcggagtccgaagccaatggtgacataatcaaatgtatcatcatcaaaaggaagctccatcgcatttccgtgcagcagttcaatttggctgaatccgccgtcttttactttctgctcgccgacactcagcatattttcactgaaatccaagcccttgatctcgccgcttttgccggccgcttttgcaagagcgatcgtccagtcagccgttccgcagcagacatcaagtgctgttgcgccttcttttacattcatgatgcgcatcgttttgtcgcgccattttttatgctgctgaaaactgatgacagagttcatttggtcatagtttttatatattttttcaaatactccgtgtacgcgctgttcttttgagtcctgcataatggtttacccttcttccactttctgatgataggtttgatcttggctgattgtcttcagacggtttattaaaatgttctgaataggtgaatttagaggcagaagtgactcaatgctgtttttcgcttttttaaaacaatcttctaatatctcttcttttgtttttcccagctgtataaaactcccgatcacatccagaaatgcatcatttccgttcataagccgcttaaatacaaaaaaatcactcgacagctttttccagcgcggaaggttgaagtgttccgccacacgatggaataaagctgattcaacgatgccgacactttcgaaaaaatcgttttcgtccttgaaagaacggtcatacagacgaattttatgttcgttgatttctttaatggctgtagcaagcgtccgaatcatgtagatatccttcatttcagatagtaaagagtagtacagcccgctgaaataatcgcccgcgagaacagtcaattggcggtttttgttttcgtctcgttttatgactctagctgtcgtcacttcatcatgggtatcaagggcgctttgtacaagcatcgctgttacaatataattttctctgtcgttgttttttatgtcagcttcttcaaataaagcatgaaaaagaagaagcttatcctcatcaattttcggcgcggaaatatgcttcgctaaataaggatgagacagcttttgttttaatttcttgttcagattggctaaagttccgtagatgtcttgcaaaaatatcacccttgtccccaaattcacatttatttcttaatctatgtatgagttttatcttttcattcgcttacgcaggtatcattatagcataaaaaaaagaaattggctgtatcctcccgctgtttgcgagcatttgcttttaacagcggggacagccagcttattttttttcgcttttcatttctccgtacgcggtttgaatcagtgcctctcctctgactttaatggcagaagtatgctctgtaaactgagcgatgatcacttctcccttgtcgagtttttcggaatggtgaaactttgtgtctgttcctcttgtcaggccgatcacattcactccgtcctcaacggctttaatgacgacaaaatcacttgaatgcttttggttcatttatagcaccctctatctttattagtcctggcgtttaatatgttccaatacttctgcacgggcagcggcatcatctttaaaaacgcctctgactgctgaagtcacagttttcgcacccggttttcttacaccgcgcatcgtcatgcacatgtgttccgcttcaaccactaccattacgccatgcggatcaagcgtttctacgatgctttctgcaattgtagaagtgatgcgttcctgaagctgcgggcgctttgcaacggcttcaacggcacgtgccagtttgctgagtcctgtgacctttccgcctcgcgggatatatgcaacatgtgcttttccataaaagggaacaaggtgatgctcacacatagaatgaaacgcgatatcttttacaagaacaagctcctcatggttttcaccgaagatagtctggaaatgttcttttggatcttcattcaagccggagaatacttcggcatacatctttgcgactcttttcggagtatcaagaagcccttctctattcgggtcttctccgatcgcttctaaaatttgacgaacagcttgttcgatttgctctttattaacttctttcatgttctatgtcctccaccaatgaatacatttaatttcgattctagcacatatgccccgctaaaagcaaagtgaatgccctgtcaggaagcccatgctcttgaaatatgaaaagccccttagaaaggggcttttctgtgaagaaataaagtgtatgtaagctagatgcatacacgatctatattcacaattattttccggcaactgcgtctttaagcgctttacctggtttgaaagcaggtactttgcttgctggaatttcgatttcttcacctgtttgaggattgcgtcctttacgtgcagaacgttcacgcacctcgaagttaccaaaaccgatcagttggattttatcaccgtttttaagtgcatctaagatcgtatcaaaaacagagtcaactgcttttgtagcgtcttttttagacaattcgcttgcttctgcaaccgcattgataagttctgttttgttcatgcctttcacctcctcccaaaaggatacattcagttcgtttattatcatttcttcacagttcagtctgattctaaacctgtctcagaaaaaaatgagagcaagtaagagaaagacaattaaacggctttttaagaaaaactgcactctgaggaatgtttgtccaacaaagtgaagaatttctgtatgtagagtaacacatataaaaagccatatcaagcattttaaagcgtcaatcccttgctcgtcaaggatttaaggtgatttaccgaacaaatattcctttttttccttttttcatcctattccttgatccttttccattattaagaacaaagaaaaaagacctcccattctataaagaggtctaccggtattacaggatgatggcgattaagccgccagagccttcgtttatgattctttctaatgtttcttttaatttataccgtgcgttttcaggcattaatgacagctttgcctgaatcccttctctcacaattgagctcagcgaccttccgaagatatcggaattccagatggagagcggatcatcctcaaagtcctgcattaaatagcgtacaagctcttcactttgtttttccgttccgataatcggggcgaattcgctttcgacatcgactttgatcatatggatcgacggagcgacagctttcagcctcacaccgaatcgtgagccctgccttataatttccggctcatcgagactcatatcagctaaagcaggcgctgcaatgccgtatcccgtctgtttgaccatttttaaggcatcagacacttgatcatattctgttttcgcatgggcgaagtcttgcatgagctcaagcagatggtctcttcctctgatttcgacgcccacaacttcttttaggatttgatcatatagatgatcaggcgcgtacaaatcaatttctgccaccccttggcccagctcaattccggctaatccggcactttcaatgaattcaaactcgctgaattggccgacaaccctgtctacgtcccggagccgtttaatatccttaaccgtttccttcacggactcctgatagctttcacgcagccaatggttttctttcagcaccattacccagcttgggagattgacattcacttctagcaccggaaactcgtagagggcctctctgagcacactcagcacatctgattcccgcatgctctctacactcattgccaataccgggatatcatatttttcgcttaaatcctggcgcatggcttccgtttccgggtgatacggcctgactgagttgatgaccataataaaaggtttgccaacctctttcagctcttcaatgactctttcttcagcctctatatagtcacttctggcgatatctccaatggtgccgtctgtcgtaatgacaactccgatggtcgagtgttcttgaatgacttttcgagtgccgatttcagcagcctcatgaaatgggatcggttcttcgtaccaaggcgtattgatcatccgcggcccgttttcatcttcgtatcctttagcgccgggcactgtgtaacctacacaatctactaatcttatattcacatcgagtccgtctgacacatgaacagacatcgcctgattcggaacaaatttaggctctgtagtcataatggttttgccggctgcgctctgcggcagttcatcctgcgctcgggcccggtctgcttcgttactgatattcgggagcaccacaagctccataaattttttaatgaacgtggattttcctgtacggacagcacctacgactcctaagtatatatcgcctcctgttcgttcagcgatatccttgaaaatatcgaccttttccaagtgatcccctcccggacttcctatccttttcaattttattaagctctttcaatcaaacacaggacactatatgtgtatgacgttgtcctatttgaatatgacatctttagaaaatttctcatcctcaatctattaaagtataaaaaaacctttctccctatttgtatgcaagggagaaaggttcattcctttttcatatcattttctaaaaaaacaggttcctgtttgtcatttaccgtatattttacagaaaacgcggggacaaagggggtatcctgccaaatcatatcctggatttcagtcccgggtttaaacgtttttttgctttttttgaggcaagaagccagctcagtccggtaatcggcatatatttctccgtctccgtcaatcataagcggcaaggaattccctgagattgggcttgtcactgtaagagagcttccatccccaagcttcttctcatcgagtgtaaataaatcacgagatagcacatccttgtaaggcggatattgatgctcctgacgatacatttggatgcgcaatttcacatcgcgaattttttctgccatctttagatcaattaatttaacagtcggatcgttctctacgtcaacaagcacgtattgatagtctcccccgctttcaaatgccgtacttggaggttcagctatgtatcttggcgctaaccggttaaagtctatcggatatttttgatatagcggtgtcgacatatctttggtttgaataggaagcagccctccatttgccttttgaaattcatcaacagcagattgaacctgctttagctggtcttgataaggaatggcatgcacactgcttttccgttcatttggatataaacatccggataaaaacacgactgccgcaaaaatgattgcgcacttcagtttacccatacagcacttccttttacagctttattcattgacagggccgctaaaaaccacgacaaacacaataattccagatatgagcatacacatgtatgcgaatgatgaaatcgcaatcttcaaaaaacggttttggcacttaaagcggcttaaatagatggaagctacagccagaaacatcagacccatggaccctagagcaaaccacattttcatcaatgccagattcaatgacgtgcgcctccccgatatgtatgatgtaagcgttatattatattttaatatacagcgccggaaaagatcaaccagattttccatccattgatagaacaaaaaaactgaagcaaagagggggaccttcgcttcagtcaacttgactatattcacctgcacgtttaagaaacactctcttggacttcgatgctatagtatgcgacttggcatacagatgcatcctctattgcctaaatcggcaaaatgtttcaggagatcccaagacttgggtgttcttctgtttttcgggctttcgttcaattaagatatgcgtttcatcataccattgacacttttacttcacttgattttcaaacgtatttaccaaatcctccatctcgtgggttttccctcttgccattaaagattcaacagcggtttccactttttgtccgttgaacaggacctgatggagagcttctgtaatcggcattttaacatcatatttcttcgaaagctgataagccgctttcgtcgtgcggacgccttcgactaccattcccatctcttcaagaacatcttcaagcttgtacccttttccgagcaaattgcccgcacgccagtttctggaatgaacacttgtgcacgtcacaatcagatcgcctactcctgtcaatccagagaacgtcaagggatttccgcccattttcgttccgagtctcgcgatttcggcaagtccgcgtgtaatcaaagcagctttggcattgtcgccgtaccctaaaccatctgtaattcctgcagcaagggcaataatattttttaaagcccctccgatttcaactccgataatgtcaggatttgtgtacacccgaaaattgtgattaataaatagatcctgcacctcttctgctgccctcatgctctttgaagatgcagtaacagttgtggggtgccgcagccctacttcttccgcatgactcgggccggaaaggacaacgatatcttttctgacatcactcgggagctcaatttccataatttcagaaatgcgcagaagtgaatctggctcaatacccttgctgacatgaacaaagactgcctttttcgttataaaagggacagcctgtctcagcacttcccgaattgcttttgtcgggaccgcaacgataatgaaatctgcgtctgaaacagcctctttcatatctgttgttcctttaatggatgtagacagcttaacattcggcaaataatctttgttttcatgcaactcattaatttgatgaattaaatctgcacggtgagcccacacacacacttcatttccattatcagttagaactaaagccagtgctgttccccaactccctgctccaagcattgtgacttttttcatgtttgattcacacctttttattttctagctcttgcaaatattttgattggtgtcccctcaaaaccgaacgcgtctctgattcggttttctaaaaaccgttcgtatgaaaaatgcatcaattccggatcgtttacaaacacaacgaagcttggcggctttaccgacacttgagtcgcatagtaaatcttcaaacgagaaccgttatgagtcggtgtcggattcattgccacagcatccatgatgacatcatttaagacgttcgtctgaactcgaagtgaatgattttcacttgctttaataatcgcaggcatcagcgtatggatccgttttttcgttaaggcagacataaataggattggcgcataatccagaaattgaaaatgatcgcgaatattttcttcaaattctttcatcgtgctctcatctttgtcaacagcatcccatttgtttacgacgatgacgacggccttgcccgcttcgtgtgcatagccggcgatgcgcttatcctgttcaataatgccttcttcgccatccagcacaaccgccacgacttctgagcggtcaatcgctttcagcgcccgcagtacactatacttctcagtcgtttcatagacttttcctttttttcgcatacctgcagtatcgacaatgacaaactcctgctggttgtaagtaaatgacgtatcaacagcatctcttgtcgttccagccacgttgctgacaataacgcgttcttcgccgagcatcgcattcacaagtgaggactttccgacatttggacgtccgatcagacagaattgaataacttcttcattgtatttcgtttcaggaatgtttttaaaatgctctgcaacggcatccagtaaatcacccagtccgagtccgtgtgttcccgaaattggatatggctcgccaaagcctagcgaataaaaatcataaatattcgctctcatttctgtgttatccagtttattaaccgctaaaacaacaggcttttttgtgcggtacaaaattttcgccacttcttcatcagcagctgtcacaccttcacggccgttcaccataaaaataatcacgtccgcttcatccatggcgatttcagcctgctggcgaatctgcgctaagaacggctcatcaccgatatcaataccgcccgtatcaatcaaattaaaatcataattcagccattcagccgagctgtatatccgatcccttgtcacgccaggggtatcttctactattgaaattctttctcccgcaatccggttaaagattgtggattttcctacatttggtctcccgacaatggctacgacaggtttacccatagtacccttcctttcaatccagccgctttcatttttacataaattttcaaccggttattaaattcatttcattcacttttatgaaaagaaacccttcagaggaagggcttaactcatttattatatcagtttttactgggatcacaactattcttaaaaatgtttcacgatcaaatacacgtcatctccgattctgtgagctattccatcaaggatcgcctcaagatttttagcgaaaagctccatctccttttggtcattgcaaaaaaagacaggtgctccccctgcaacccggtttggatttgtcgtgattacagacaaaatcactttcgtaagagattcactcatcctatcaccttatcctgattcttgataaattcagtcggcattctaatcgcattttccaaggttggaacattgctaataatttgaacagccgtttcgggatggtgaatttgcgggagaacaaatactgccactctcccatcatttaaatcccgttttgcaattggtgtcaaagatggctctcctgaatcccgataaaccccgagcacattggaaacatcaaataaaatggcctgacgctgccctaaatttgctatcgtcgctgctgaattaaagtttttcggcgttaaaataaagcccatgccatgctttaaaatcagttcctgtttctctggaagcccgatattcatcatataaatattatcaacaaacagtcccggaccgtcaaagcgcggctttatgtactcgatgtctacaatatccttcaacacactgcccgacataaatttcatggccagtaaaaaacaaacgacagccgctatgacagcagcccagatggataaaaacacatacgcagaggttgtcaaaagcgctgtaaagatcacaatataatttctgctttcaaacgcaatggcaatcccctcaatatatgtgctaccccttgagacaagttcatacgaatccatttgcgtcaatgtgttccgctccatgtttcggacatctctaaattgcgtcgctgccaatgttaaaaatgtgatggccgtaaattcctcctgcaaaagcgccggcataataattgcacctaaaccagccgctatcaaccccagtgcgatgtgaatcactttcccatgaacataggtcggatactggcggtaatccgttttcagcatataaagccttgtcgcaattccggcaatgaccccaacaataatcggatagatgtaatcactcatgacattttggtagctcctttgtttgatcttttgcttttctgaccaatctggcttgcgaggtattcgtatttagatatgccaaacagcaatatcatccccgcagaacacgcattcagccattgaaagccgccgacagccatagccccggccaacttctggatcacaaatgaatacaccagttcgccttggcacatccctaggacaaataagacaagctgcttctcaaaattcctatcaacagaagctgttaaaagcactattaatataacagcagcccactcaggttttatgatgaaccaaaccgggtcatataatgcaaaaagataaacaaacgcatacgcggaaacaagcgtcagatagaccatgatgtaacgaaaacgatacattcccaaatacccggcatagacacatccgcaaacgaaaaacatcaaatatgcagcattcagggaaaaatataaagcgatgtcatgtatgcttagaataatattagttaaaataaagacagagacggcaattcgtcttttcgtcttttcaaaaataaatgttgtcagaacccacagaaaccacattgaccaatagtaataaaattgttccattttacttcctccatattcccagtatggagttcaagcacattttttaaacaatcgatctcatattaaggagtatgatcatgggaaaagacagacaagagaaaaaactcaaagcttcaggcagagtcgaatcagaccgcgaccagtccattcactatgacggagcgacaagccttgaacaaaacggaagattcaaaaagcgaaaatcataatacaaaaagcccaaaccacatatggttttgggcttttatcatttatcgcacactatagcttgatgtattgatccctctctctgtgagccaatgatgggtttcacctttgatcacaaggggcgccttttgtaaatcggcaatcgttctggtgcccagcacggtcataatcatctttaattcctcaaggatcagctgaatctcctcaagcagtccttcctcaccgctgtcagtcagggcttttaaaaaatgccctgccattccggtgcaagaggccccaagcgcaatggcctttgccacatcaagtgcatcttgcagaccaccagaagcgatcatggtgcttgcaggaaactcggagcggatttccgccaaacttgcagcggtcgaaatgccccacgagttaaaaaaggagatttgccgctgtcttcggagattttcgattttcgagaaatttgttcccccgtaaccgccaatgtcaacagctgcagcaccagcttcatacagctttcctgctgattctttgctcataccgaatccgacttctttcacaatgactggtacgctgacatgactgcaaatttgttcaatgcgttccagtgcgccgctaaagcttctgtctccttcaggcatcacaatttcctgaatcacattgaggtggatctgcagtgcgtttgccccaatcatctcaacggcttcctttgcctgggcagccgttgcctcgcttcccaggttggcaaaaatcagcccgtttgggttttcctttcgaacaatttcataggaaagacgctctgatggatcttttaatgctgacatttgcgatcccacagcaaggggaattccagcctgagaagccgctcgcgcaagcgatttattaatctcatatgtaagttttccaccgccgccagtcattgcattgataaaaatcggcgaactgcttgaaagttcgccgatttttgtggaaatatctacttgttctaatgcaagatcgggcagactgacgtgaacaaacgtaatatcatcaagacctgtttcccgcttctggccggtggacaaggcatgattgatgtgttgtctttttcgttctgctcgagtcacgtttatcaccaattattttagtttattcagcttatctccgatcagatctccaagctggaagccagtgcttgtttcttccttcgcttgatattgacggtaatcttcctgatcagctttaggcgtttcttcaagttcacgcatgcttaatgaaatgcgctcctcattttcattcacatcaagaaccttcacttttacagtctgtccttcttcaaggacttcatgcggcgtgccgatgtgtttattggaaatttgagaaatatgaacgagaccttcaacacctggaaggatttcaacaaaggcaccgaagcttacaagacgctgtacagttccttcaagcacatcgccaggcttcactttttcgccgatttggctccaaggtccaggcagtgtatctttgattgataaagaaatacgttcgttgtcacggtcaaccgataacactttcacttttacttcttgtccctcttcaacaacgtcagacggtttctctacatgagagtgggaaagctgtgaaatgtgtacaagtccgtcgatgccgccgatatcaacaaatgcgccaaagtcagtcaggcgctgtactttgccatcaagtacacttccaacttcaagagactgaagaagttcttgttttttattcgcttgctcactttcaacaacagcacggtgtgaaaggatcacgcggtttttatcacggtcaagctctacaacgagcagtgacagtgtttttcctttatagtcagtgaagtcttcaacgaaatgtgcttcaacaagtgatgccggaataaaaccgcgaacgccgatatcaacgacaaggccgcctttcacgacatctttcacttcagcttcaaacacttcttttgtttcaaattttttctcaaggtcttcccaagcgcggtctgcatcaacagcacgtttagataaaatcaaagcatcgtcttccacttttgttactttcaggtcaagctcgtcgtctactttaacaacatccgatgctttctctacatgaagacttgataattcactgattggaataataccggattgtttgacattgatgatttctacatctacatgtttgtcttctacctttgtcacaatccctttaactacatctccaacctctggcacttgaacatcaatttgattcatttcctctgtcatttgaataacctccttggtccaaacctacacagcttaattaaaacggtttgaaagctgaacatataacatgcccgcttttagccgaatatgtattaaagaatcatccaaaaaagttttttgaatgatcaataaaaagttttattagtattaacttctaataaaaggacaggtttgtcaagcaataacattctatcttcgttgaaaaattcaaaaaaagtggcatttgccatcctcagcgggacttttgctccacagcctcgaggattttatcagctacctcttgaatggaaagcgatgtcgtgtcgatttcaagagcgtcttctgctttacgcaacggagatacttcgcgctctgaatcaagcttgtctcttcttgcaatttcctcaattaatgtttcgaagttgacatcaaagccttttttcacattttcttcataacgacgtttcgctctctcttcaacagatgccaaaagaaagatttttacttctgcatttggcagcacatgcgtcccgatgtcacgaccatccatgacgacgccgcctttttccccaagctgctgctggcgtttcaccatctcttctctgacacttctgtgcttggccgcaattgaaacttggttgctgacttcatctgttctgatcgcctcagttacatcggtgccgtttacaagcactttttgtccatcttttgttgtaatcagctcaatgtctgtccgctttagcagctcagccagtttttcttcatctgtcagatcaacgttttcctgtaaagccgcgtacgtaatcgcccgatacatcgctcctgtatcaatatatatgtacgattttttctcagccacaattttggcaacggtgcttttccccgcagctgccgggccgtcgattgcaatcgataatttcttttccataattcctctccttgctcttttctcctctatggattgtatcacgaactttatgaaaaagggtgaaaaattgatgaataattaatgtttgaaggtttcaatcctattgttttcctccattttatccaccccttcatattgaatcacttttgatacgtatggttcaatatgctgatagtgaaaaagaaattggacaccaagtaaaatgatggcctgaatgaacaataatttgatcagcagccgttcaaatgttttcattggagcacctccattacaaatagtatggaagtgtttgccgatgtttattccattcgggcctttcttctcttatttaactggcgcctgatgcagtattgaagcaaagcctgctggtcacctgctgcaatttctgaatactctaaagtcatttttcgtttttctgacttggggtcattaaagattcgtctgacaactgcttctgtttctatttgacgtgtgtgctcctcttcaggaagacggatgatcaggcgcaatgattcccccgattgaaaagaaaggccatcagctaaaaccacggcgatgccgcctgcactgatgttataagatagtgtgcggatctcttcctcatttcccggctgaatttgcacatctaataccgcatcagttcttacatattggcggcgctggattcttttcattttttcacggggaggcacttcaagacagatcatttgaagtttgtccttcactttaccttttatacggcttataaagcgataaggaacttcgtcttttcccacaaactctaccgttacttccatatcgttatgtaaaatcacagttcgccctgtaactacatcaacaggatacgcgatcaaaagttcattgttttcgatgctgaccgccttgctttttgcctttttcaattcattttcttctatatattctaaaagtacagtttctccaatctctatcattgacttcactctttcgcattcaatatactcacgtttttattaaagcacgtaatgaaaaaaaggaaaagacatttagtcctttcctcctgttttttataggtctttatatataggttctgcattttttagtttttcaaccttttcttccgatccgtctttggcattgatatacattctgaaagtgtcattttcaattgttccaagcatttcgtaacataacacttcttgacctagttcatttgtaatcaaagcgagccttgtttctctcacttgtacatttttatttaatttagactttgcctctgcttcagtaattgcaggcttaggtatggttctttttctgtgagatgtgaggaagtctcttgctgaaaagccgacaacctcaccgtcatccaaggccactttcatacgaattgcctccgggtacatccggactttattttcaacaggaacatatgaaaatacaccgattttatcatattgggcactttcatcaatttccaaatcatctgtttcaaatccgtttttctttaaaaatgcaagcgctcggttcgatccgtcatttaaactgattttctgatctttcacttccctgttttggatcaagtataccggatgcccgcccttcttcgtaatatccatataaatcactgctttatggtctgggtctttcatgctgatgctatatacatcgcgatttgttttttttccgctctttaccactttaattgaataattgtcatctggggcaaagcgctcagcaatttgttttgcttcctgttcggaaatttgttttcccttcagatggctgaagcctttctcttcttttttcgtactggtgaagctcgggccaagatcagtgccagtggagaatgcaccaacatttttttcgactgttttaaagctgttgataatcgtattatcactttgtttttcgtcagaagccagggccatttctacgtccatccagcgaaggtttttgctcatgacaaggtgctgaacatgacgcaattcattttgtatatcttcggactgctgatatagcttatttagtgatgtatactcgtttttatcaagcggcttttggtccaaatctctgactgacgttttatagctgaaatcgccgatctttgataatagctcttcagttttattaaacggcattaatgtaagcggcagctgactgacactgttatgagcttctgatgtaatcctccacacatcgatcaatgcaggcgacagtgatttttggctgttcatggcaagtgttgttccgattttatcatgaagctgatccatctgataggtaagctcatgaaacgcccgctgatagttattttcagcatgaagaagaactgcgtctttttcctggtgttctttgtatccccagtagcctgtaccgactattgcaataccaagcacggcgattaaaattcctctgatcatttatcacacctctttttatgctttctcatatctgctactcacagaaaatgtgtttaccgattcttttaatctgcggacgcccccaaatccacggacttgtagccgtatccggattaaagtagtaaagtgcttcccctgatgggtcccagccattgatggcatccagcactgcttctcgtgccgtttcattcggctgcatgtaaatttgtccgtcggctactgctgtgaaggcaagcggctcaaaaataacccccgctactgaatttggaaataacgggctgttcaaacggtttaaaatgactgctgcaatagcaacctgcccctcgtacggctcgccccgggcttcgccataaaccgcttgagcaagcagcctgatatcgttgttggaaaatccaccaggcatgttcgctgctaccgcatcctgttttcttgcttttgctggtgtattgttttgctgtttattcgcattcgctttaggctgctgcgttgttttttccgcaggctgtttctgccgtgcttctgcttgttgtcttgccttttgtgttgctgcttttgatggtttcgtctgatactttagcggaatttttccgtaatgcgtgaatgtattccctttattgagctgttccatgacatattcacgatagtattttgatttacatattaaggtttgctttgttttagctcctacaaggccgtcaacctcttttaacccgaattgatcctgaaaatttcgaactgcccagtacgtcccccatccataaaccccgtcaatttttccgttataatatccgttgtattgaagacgcgcctgaagctcgaccacatcatccccggttgcccctctttgaatgacctgattcgaaaaggcagagatcgtttcagtattaataaacgccgttattgtaaaggaaaaaaggatgagacatgccataatcgatcctttggacttcatcttttcaagcctcctactgcaaatttttaagtgtaatcgtattttctgtaacgaggttatttttatacactctttccttgttatccctcagaacataaaaactgcacacaaaaaagccgcacggttgctgtgcggcttctatacttgcatcatattaacggaacgggcttttttcgctttacgcaaaccaaaccaccataaaaataccataaatggaagcatataataaatccaattgctaagcgctgttaggataaaatcatatgatccatgcaaaagggatgggaccactaaagaaagagtaagccactttacacgcgccttatcagcggaaaaacgggcttttccaaggtaaaatcccattataacgccaatcaaggcatggcatgaaacaggcagcagcgccctgacaaacgcatgctccacgccgtggccaattaaataaagaatattttcgagggttgcaaaaccgagtgatacacttgtaccgtacacaatcccgtcataatgctcatcaaagtgggcgtgcgggtaaacactgatcatcagtataaaccattttaatgattcctccaaaaaccccgaagataaaaaagaaacgaaaaagcttccgcctcctacattctctttttcaagtacatactggataaacattatgggaaatacaagaacaaccccgagaaaaaacgaccgtagcaccatatgtacaggttcattatcatactgatcttttaaataaaaataacttaataacgcgatgccgggggcaattcctgcagagatgattgcaaacatcaggcaacctctttcctttatattcctacgtctatcctaccatgttgtttaaaattttacatctgtctgcacttaaaaaaacataaagagcatacgaatgcatcatatgctcctcatctttaatggttttctcttttggcgatttccgctgcgatatgcccccgtgaaacctgccgttttcaataaatatttcatttgcattgtttcccgcagcaataacaccggcaataaagacaccttcaacgttcgtttccatcgtttcttcgttgaaatatggacgccctgtttctttatcaatttcaacaccaattttttcaagaaattgatgatcaggatgatagcctgtcatggcaaatacaaaatcatttttaatggtaatgagttctttctctccggagcgaaacacaacttcatcctcggtgattttttcgacacaagcgccaaattccatacggattgtaccgtttctgacgagagcttcaaattccggcagaatccacggcttaatgcttggagaatactcattgcccctatataaaactgtgacacgcgccccagatttcacgagttcaagggcggcgtccacgcttgaatttttcccgccgatgacaacaacatctttatcaaaatacgggtggccttctttaaaataatgaaatactttcggcaaatcctcaccgggtatattcatatagtttggatgatcataatagcctgtggcgatgatacaatatggcgtcgtgtaggtctcttttgacgtctcaataacgaatgtgtttttttgcgttttcgtcactttatgcaccatttcaaacgcattaacacggatgtttttccgtttaacgacttcccggtaatacgataaagcctggattctgacaggcttcctgttctctgtaataaatgccacatctccgatttcgagcttttcacttgagctgaaaaaggtttgatgcgtcggataattgtaaatactgttaacgacattgcctttttcaatgacgagggcatcaatgccaatttgttttaggtgtatggcagcagatagtccacaaggtcctccgcctataataattgctttttcttgaatcatttctgtcaactcctgcgattggcatttcacttcatattttctatttccgaataaaaaaatctcctattttatcataggagattttttatttttatgcaaatcatcaacttatatccagcctctaaaacgcgaagcttcagccattttgcgaacgccgaccatatatgcagcgagcctcatgtcaattcttcggttgttagccatttcgtaaatattgttaaatgatttgaccatcattttttctaatttttcttctacctcttcttcactccagtagaagccttggttattctgaacccattcaaaataagaaactgttacgccaccggcacttgccagcacgtctggtacaagcagaatgtcccggtctgaaagaatttttgttccttcaagcgttgttggtccattcgctgcttcaacgacaattttagcccggatattatgggcattttcttctgtaatttgattttcaatcgcagcaggaacgagaatatcacaatccagctccagcagctcttggttggtaatggtatcgttgaaaagctttgttacagtaccgaagctgtcgcgtcggtcgagtaaataatcgatatcaaggccttccggatcataaagtccgccatacgcatctgagatgccgacaacttttgcccccgcatcatgcataaattttgccaaatagcttcccgcgtttccgaagccttggacaacgacacgcgcacctttaatatcgatgcctctcttcttagccgcttctttaatacagatggtaacaccttttgctgtcgcagattctctcccgtgagatccgccaagcacaagcggtttgcctgtaataaatccaggcgaattaaattcatcaattcttgaatactcatccatcatccaagccatgatttgtgagtttgtaaatacatccggtgccggcacgtcttttgtcgggccgacaatttggctgattgctctgacataccctctgctcagacgctccagctctctaaacgacatatcccttggatcacaaacaattccgcctttaccaccgccatatggaagatcaattatgccgcattttaaactcatccaaattgaaagcgccttcacctctttttctgttacgttcgggtgaaaacgtatcccgcctttcgttggaccgacagagtcattgtgctgcgcacgatatcctgtgaaaatctttactgaaccgtcgtccatacgaacaggtatttttaccgttaataatctcatcggctcttttaacaattcgtatacctcttcgggatatcccaatttttccagagccttatgtattacggtttgggttgattttaatacatcaagtttgtcctcttctgtatgaccggtgtttcgatcggctgccatttgagttaacctcctagaatcttctgtttctcacatgctccctttcagagaatagtatacaccttcatatgatctgtgcatagaataaacgttatgtttttccatgttttttaacgaaaaaaaactgctgaaatcagcagttttccgttgcattcttatgaaaaatgagtttgtatcgtctctacggcattaccgtccataatgagcttaccatactcttgcaggcgataaatcgttaaagttgtcggattgccgtattcagccagaaccgccacaaccccttcagccgtatgtgaccctagatcttcaaggcttaaaaagtactgcccgtcatagtggtagacagttccccctgtgataccgattcgctgtaagctttctgaaagctgaatgatatcttcaaaggaatggaattgatatatgatgtccgcgctttcatcaagcttgacttgcatttcgatgtaatcatcatcatactcatcgtcttctgaatcggcgtcttggttctttgttacaatcacgaccatcccttgtgcttggagagaatacacttccactgcaatcggtccattcgcttcaaagccgagctctgtatttgcttcattcatcatatctttaaataactggtggactttgaatgagtccttccagaggtcttcttttgtcaatccccggtctgtcaaatcatcgagggttaaaaagattttgatcttattataattcagacgctcaagccgcataacgttccctcctgcctctacttgcacacaaatcatataacacattatatgagatgatgagtcataggttcttaattgttatcagtttacactgagttcactagtaagacaagcacaatgcagtttttattgccatatggatttttgctttttagaagttattctggcccgcaaagagtcacaatgtgtgtttcaggctcagcacctaaacgaagaggcacttttgtcgtgccgtagccgttgctgatcagatatgccgcgtttttaacaatacctgttttccccagttcataaggaccgaattttccaaacctgatctggcctccatgggtatgtccgctgagtatcacatcaataccgtcatcttcattgatttgttcatgaatctccggattatggcaaaccagaatattcagctggctttcatcaagttctttgatggcttcttcataatgatccatctccatcctgatatcatcaacccccgcaatcgcaatcgtatgcccattgtatgaaaacgggactgactcatttctcagagtgatgacgccgtgcgctttaaatatggaatacagcttatgctgcctgacttcataatcattattcccccacacaaacacgatagggaccccgaaatgtacgagccttttgatgttttcctcgattctcgcactgggcaccccgccctcagctaaatcaccgccgattataaccaagtggggggcatggcttcgcgctttttctaaaaggtcttgatcgatgagacgtttgtgaatgtctgaaataaaaaagattgtcagaggcggcttgcccttcatctttgataaaggaaacgtatgtgtcttcaaatgattgccttttgctgttgcatacatttttgccgtcattgccgctgccgcaacagttagtacaccggcaattttcactgatagcttcataaaaaaactctccattctttttagaacttatcaataagacggacaataaaaaaaagacgtttctatcgtttgagaaaacgccccattttatttactttcaaaatatagattaatgtcatatttgtgcttcatcatatgaaaaacagactctctcgccttccatttatcgggctgcggccagagatcagtgcttttctgaataatttcacatctcagtttatggaaatcagtctcggatttttcttcctttttcttgaaataatatgaagtacagtaggcaaaagcggttgccagcatccaaaataaataaaaggtatggctaagtatttcttgaagtataagctgaggctccgggcttttgatcatgatcataacacataataagcctaggcagataagtgaagcccatcgccatctgcggcattgtgctgcataattttcgaatttttgttttcgttttaccagcgcttggagcatctgtttggtcggcgcgtctgtaaactgatccagctgattccataaggattccatacgcttcacaccttgtccattttcattgctacaatatatgaacgtaaaataaaaataataccctattcatccattaaggggatgtccaaaacttgtccggtgtaaacatcatttccattcagatgattatacgctcgaattttttcttctcctgtccggcttttataatacttcatggaaatgcggtatagcgtttctttcttttggacggtgtgcttgacaacgcgattcggcacattttgaactggctcagctggctgttcttgctgttgtactgttgattgggaagaggaagcagccgcggcggttgcttcctccttatttgccgagtcttctttatccgctacagcagtctgtttcttatcagcagctgtttttgccggctcttttggcttggaatcttcaggctcttgttttgactccttctgcagtgcggtttctttagtgtctgcggtatcgtttttatcctctgatttcgggacaacctcatatttgctttggctgctgtcaataaaaacatcttcataatcgtcatgattatccgggtggctctttagataaaataaggtgactaaaacgataaccggcacaaatacaaatattactgcgagtactgtgaataatggcgtttttgttttgccttgcttttttttctgttctctttgattttttacagattgtcttgtcggaaggctttctccatcatcgacataatcgtccgccaatgcggcgttttgatcttcataaagattctgggcttttcttctctctactctcgacatgttcgtcatgtttatccctcctcacatgttcaaaacgaatctgacaggcaaacacggcatcaatgataaaatgcgccgtcatcggaacaaataagttgccggtccattcatacatcagaccgagcaaaaagctgattgctgtcaccataataaataacagccattttgacaaataccgaaagtgcagagcggcaaatataaggctggccgcccataaaccgatatgagtctgcagcactcctctgaataacatttcttccgcgaaagcaatcagaagcgttaaaaatataatatgagggattgacctcttactgaatatttttttattgattccgccgtcatcatataaatgagacggaaaccatttcattactgccatatcggctaaaataacaataacagctatagaaacaccataccagatgattcgcatatcgcgaatgtcccagagctttaatacgtcccgtacatcctcaaaaaagaacagtcctgctgcagcagcggcaaagatgatgagtagctgcgtcaaatataactgcttcagcatatcacggtcagacatatgctgaatataatctttttgctgtttcagttcagctcacctacagtctgcaagctgaatatccggtgcaattccgaactccagctgtctaatggcgccattttactccgttcccctttttgttcatacaaggataaatcaaaaccgcaatgtgaacagcacgggaggtttccgtcatcaggctcgtatgattcatcaaagtaggttaatagtgcctgccttaaacagccatcacgctgaagcaaaaatgatacacggtgcattttttccagcttcagctccatgcgatatgaaatttctttcttcatcagttcaactgatgttttcccctgcataaagagatgaatcatcatacgggcctgtgtctctccgacgccatactgaagtaatacgtcacgaagccttctctcatcccgctcctccgtcttctctagcacacggatcacgtcggcgatttcttcagctgtgacactctccatctggataatctgttcctgcaattcaaaatcccctggcgcccgcagcaaaatgctgacactcggctttccgtcgcggcccgctctgccgatttcctgcataaaagcttctgccgtctgcgggaggtgaaaatgaatcacatatctgatatcgggtttatcgacacccattccaaacgcattcgtacaacatatcacatcaagctggttatgaataaactgctgctgaattaaaatccggtcccctgactccaaaccgccatggtaaaagtcggctctgctgctcgttttgctattaatttcacccgctaattcctcggcccatttccgtgtcggacaataaacaattcccgggccttgcagattttcaaccagctgaatgaccctatctattttttcggcagtatccgccgcattttcaaccctcagtgcgatgtttgggcggttgactgagttgagatggcgtacagcatgctgcagctccagcaggttcatgacatcttgcagcgtttcctttgtagccgtggcggtcaatgccagaacgggcgggtgaccaagtttttttctcagctgcccgagctttgaataatcaggcctgaagtcgtgtccccattcagaaatacaatgcgcttcgtcaataacaaataggctgatcgggacgcttttcaatttttccaatacatatggagactgtaaagcttcaggagacaagtacaaaaatttatatcgatgaatatgttctaaaacaaattgtctttcctgcctgttaagcatgctgttcaaagctgcagcacgcttttccccccgggctttgagctgctgcacctgatcctccattaaagaaagcagtggagaaacgattaataccatgccgtcaagcatataaccaggcagctggtagcaaagcgatttccctcccccagtcgggagcattgcaatggtatccttcccgctgagtatgctttcaataatgtcctgctgcccttttttaaaggaagtaaaaccaaaaaactgatataacgtttgctgtaatttagtcatattgctgcacctgctttgtcaatgccagtctgatttgaaagtagctgaaccgctgttccagcccgtcgcgaatttgtttgattttattcgtccgcatccgtttggcaaactctgcgatttgaagctggtcttctgctgatacatagtcattaatcataaacgcaggctcatggagagaaatctcgacaatgtggtcttcaatcgtcgctgttttcagctttctgatttcagcaattcgctgtatcggaaacccttgtttgaccatctgccatgttttcctcgtcgactctgtcagggcattatctaagtgcacatcagaaaggagatcctttaacaaagcatcttcacactccggaagagaatgaataaaataatgtaccgaagcccaaaacatgatatagacataccattcgtcttctttcagcgtatcagcaagctgcctgctcgtataaccgatccgatggtgcgaggttaaggagtagacaaaaatttgcgctgctttgttttcaatctttttcaaatgcgcctcaagcatggcaaaaaggctttttgccatctctatatgatccgtatgccgggacaggtatttctttacccagtgaagtgtcttatgatcctttgtgacagggatatactgcctgctcccttgctgtttatgggataggacctgcacaagcagcgaaagccttttccaaagcacgccggcagcctgctgataatgagcgccgtgacaatgaacgggccaaggccgctcgctaagggcatgtctcaaaactgctgcgccgctggctgtcactttgtatgtatctgattcagacattggcgcgagatatgaatgcttttcaagcttgtcaagcgacgcagaaatatcgcttctcgaacattttgccgccattccaaagtattttgcagtctgaaataagccggcatcttgaatggtctgtgacgatctcttgcctttgaataggtgaaaaacagcgcttcccgaccgttccccgtttattttgcaaagacaatcgagaaccataatatcgaagtaatttaatgacaacctatccacctacattcttcctgacaaaaatcgttgatttgctctttttattttaacagatttcaaacagaaatcgacgtttaaagtcatcattaagggggatgttatgtagataaccccttatgtgataagcattctcaatcatttttctgttgaaatgtggcagcaacatcattacaataagtaagaggaataggtgttaaattgattaaatataaagattgatccatttgttccaccaagaacaatctgggaggttttattcatggcaaagtacacaatcgtagacaaagatacatgtattgcatgcggcgcttgcggagctgctgcaccagacatttacgattacgatgatgaaggcatcgcgttcgtaacgcttgatgaaaacaaaggtgttgtcgaagttcctgaggtactggaagaagatatgattgacgcatttgaaggatgccctactgattccatcaaagtggcggatgagccatttgaaggcgacccgcttaaatttgaatagaagtaactaaaaaaagctcccgaacgggagctttttttagttaatggatatgtgcacttcgctgctgctcaatccatggcttaagcttgataaaaattagtgagaatacaaccgtaattacaataccttttatcatgttaaacggcaggatacctgcgacgactgctgtttttagcgcgctgtcggataatgccggtgaatgtaaaaaccatgtgtatgccggaagaattagaacataatttaaaatactcattaaaatggtcatcgctgcagttcccaaaagcaggctgacagccaagccctttgctgagttgagttttttaaataagaaagcagtcggtaatataaagagtgttcctgcaataaaattcgcaatttgccctacaggaactccggccatgcttccctgaatgatatactgaagaacattttttatcgcttctacggcaatacccgccaaaggtccgtaaatcagaatggcaataatagcgggaacgtcgctaaaatcgatttttaaataatccggaagacccggaaacgggaaatttaacagcatcaaaacaaatgcaatgctgctcagcatgctgaccacaactaatttttttactttcacttcattctctccttttcgatcacatcttactcgaaaacggaaaggttcttttccagccaataaaaaaaccgcttcatatataaaagcggggtttcgaaaattaggctaggcaaagaaacgtttgaaaaattcaatttcaaaacgcttatgaacctccatcttctcccatccagactgtactgtcggctccggaatctcaccgaatcctgctgtaaagacagctcgcgggcttagagccattggctcatcaccgccggtagggaatttcaccctgccccgaagattgatcatatgaaatttaattacattataaacgataactggttggctgtatagagaattgcttcaaattaaatatattacctgcaagctatcagatcattgatttattaggctttacttttatcctttactgcgtcaatacacgttgacactcttttgagaatatgttaaattatcagatatttagtttgtcaatttaggaggaaatctaacgatgtttcgagtattggtctcagacaaaatgagcaacgacggtttacagccacttattgaatcagactttattgaaatcgttcaaaaaaacgtagcagatgcagaagatgaattacatacttttgatgctcttttggtgcgaagcgcgacaaaagtaacagaagaccttttcaacaaaatgacttctttaaaaattgtcggaagagccggtgtcggtgtcgataatatcgatattgatgaggctacgaaacacggggtaatcgtgatcaatgctccgaacggcaacaccatttcgacagctgagcatacatttgcaatgatctcttctttaatgagacacattccgcaggctaatatctcagtgaaatccagagagtggaaccgcacagcttatgtcggttcagagctttatgggaaaacgcttggtattgtaggattaggccgaatcggaagtgaaattgcacagcgtgcgagagcgttcggtatgactgtgcacgtttttgatcctttcttaacggaagaaagagcgaaaaaaatcggcgtaaacagccgtacatttgaagaagtgcttgaaagtgcggatatcattaccgttcacacgcctttaacaaaagaaacaaaaggcttattgaataaagaaacgattgcaaaaacgaaaaaaggcgttcgcttaattaactgtgcgcgaggcggaattatcgatgaagcagcacttctcgaagctttggaaaacgggcatgttgcgggagcagcgcttgacgttttcgaagtcgaaccgccagttgacaacaaacttgttgatcatccattagtcattgccactcctcacttgggagcatcaacgaaagaagcacagctcaatgtcgctgcccaagtgtcagaagaagttctgcagttcgcaaaaggcctgcctgtcatgtcagctatcaacctgcctgccatgacaaaagatgaatttgctaaaattaagccttaccatcaaattgcaggaaaaattggcagccttgtatcacagtgcatgaaagaaccagtacaggatgttgccattcaatatgaaggcacaattgctaaacttgaaacatcgttcattacaaaagcccttctgtcaggctttttaaaaccgcgcgtagactctactgttaatgaggtcaatgccgggggtgtcgcaaaagaacgcggcatcagcttcagtgaaaaaatttcctcttctgaatctggatacgataactgcatcagcgtaaaagtgacaggagaccgcagcacctttactgtaacggctacgtatattcctcatttcggagaacgaattgtcgagatcaatggatttaatattgatttttatccgacaggtcacttggtgtatatccagcatcaagatacaacaggtgtcatcggccgagtaggacgtattctcggagataatgatattaacattgcaactatgcaggttggccgtaaggaaaaaggcggagaagccatcatgatgctttcctttgacagacatctggaagataaaattgtgaaagaactaacaaatgtccctgatattgtgtctgtgaagctcattgatctgccctaatcaaaaaaactcaagctatctatatagcttgagtttttttatttctatccccgtgtgtttttatgcaaaatatctaagacactccttagctcagaaacaggaatttggcctggtgcggacgcctcttctccagctccaaaagtacaagccgatccaaaaacctcaccgctcagcctgctgatgagccctgttgcagccattgacattgtaataatggggcggtctgcatattttgttttcattgtatacgtcgcatcaagcagtgttaggagatctccagtatcattcggcatgacagccatttttggaatatgcgcgcctaagtcctgcatttttcgaagtctggaaataatttcatcttttacaggtgttttttcaaagtcgtgatttgacatcaccacatagacgttgttttcttccgccagcgatactaacgcctttacatttgcatctcctgaaaataattcgatgtctatcagatcgatgtcttttgtttggattgccgattctagcaaagcaagataggaactttcgtccatctccatgctcccgccctctttgtgggttctgaatgtaaatagaaatagcttgtcttctaaagatttacgaagcttagaaatgagctttgtgaccgcttctctgtcattcgctttttcaaatacgtcgactctccattcaacaatgtccggattcagtaattttactgcctctgcttcattcagaatttgtttttccgtctttcccatcagcggaacgatgattttcggcattccttccccgatggaaactcctttaattgttaacacgttcactcatctcaaatcctttcaatcgttaccttgttttattatacacgtacaacttttttttgaaaatttctattatatgaatagcaactaaaaaagagcctcaaagggcccattttagtttaagaaaatcggatttggagcagccggtaccggaattgcatctgatacgtcatatttgccgattttgtttgttctggtttcggtaaaggtcacttctgtgaagccaaactcttttgcggttaaaagaagtccctcaatcattaaaatactggcaatagaatcctcaacttctgagtcctttgagaaacggatatataagtgcttctgtttcttcgttacagattggacagtacccgcttgaataagcggtgttgtatctttttgactgctcgattccatttccttaatcgcttcttttactgtatcaaaagaatgatttgacggaacgagaaagtcttgtccttgtttattttggtacaagtagtaggatcgttttgactgtttgggaatcgaaatttccgtaaaagtgccatatgagccaatccgaaccccagtctcattttgatccgataaaaatttgactttttcataaggactccattttaaggattctttaagcaatttttttaacagtgtatcatcttttacagaaaatgccgtagctggctgatggactcgtatacttaattccttctgctttggtttttcttttatttctacttcatctatgaaggatggaattgtaatggcatgatccaagatatccaattcactacttacagtcagcatgtcctggatcgtttggtatgcatttgttttttgaatgctgacgggtataattgcagatgtatcggcatcagcaactgctacagtgatgtaattgtcttgttccttttcaggtacaacaaacgatgtatgatccagggatgatgcagcttttgggctgtcttctgtctcagttttcgttactgcgttctcttgggacgcttctttttgttgaggctgtgcctgatcaaagaaatgaggagaaataatgaaggcgatataaaccgcaattgcagcggcacacgcggggccaatccacctgacagcgggcttatttttacgctttgccatcgtcagccgcttgtaaatatcctgaggcgaacgatggtctttaactgccggaagttgacttaacaactcctttatctgttcttcgttccattctgacttcatcatccattagctcctccctcaaaagctccatatgtttccgaagtactttgagccctctgtgttgggtcgtttttactttgctttccgagaagcgcagagccttggctgtttcctgtattgaatatccctgaataaaccgcaagataatcacagctctttgatcgattgtacattgatcaagcgcagcataaatttcccggacattttcatgttgaacggcaagttcgtccggtagcaattgctgatccctgacatcctgtgtatcccagtcaaatgtaccgagtatacgctgtctgattgtttgctgtttacggaaccagtctatcgcaacatggcgtgcgatagacaatagccatgttttttcactgcttcttccttcaaacgtatgataagaatttaatacccggatataaacctcttgaagaaggtcttctgtctggtttttatcctttaccatataaaataaaaattggtacaaatcttgatgatatgtatcatataataattgaaaggtttcttccatttgaaacccctccgttcacttttttgtcgtatgaatagcttgaaaagttacattacaactatattacgagtaactggaatttggaagggaatttatattaacatatccttaaattttattaatgttggctattaaaaaaacacccgctcagtcagcgggtgtttcttatggaacaagattcttcggcaaattcagactcgattttaccgttttgtcggaatataaaaagtaaatgttgttcctttatctattcggctgtgcacagtgattgatccgttgtgggcttccacgatatttttaacgatagccagccctaacccggttcctgctctgccccttgtccgcgctttatctgccttataaaaccgctcaaagataaatggcagatcttcttccggtatgccggacccggagtctttgatatcaattttcaatccatccttcacagaatggactgaaatggagacactgccgccggctgaagtatgccgcagcgcgttatcaatcaaattggtaaatacctgctccatcttgtcttcatcaaacataaattcctcttctgtgagagaaatgtcatgatctaaagcaatatttttttctttcgcaacaccggaaaacttccggatgatcttttctaaaaactcattcacattgattttttcataatgtaagcctgtatggcctgattccattcgggctaaatcaagcaaatcattaactaaacggcccattcggagtgattcgtcataaatgatttgggcaatttctttccggtcttcttcagagcttgcaatgtcatcaacaattgcttcactgtatccctgaagcatggagatcggtgttctcagctcatgactgacatttgcgataaagtcctcccgcagcttatcaaggcggcgttcttctgtcatgtcacgcagtacggcaactgctcctctgacgtgcgattccgcataaagcggcgacatcaaaagcacccatgatctgccttgcagcgtcatctcaatcatttgttctttttcagtgctgacagcgttttgaaacagctcttttgcttcaggcggaaggttgtcgccttctttgatattcatgttctgttcataataccaagcctgaagaaaacgttcagccggcgggttggtcacaagaatcgtaccgtcaatattaatggtaataaccccgtcagccatactgctcaaaatgttagaaagctgctctttttcttgattgagcgcattgatatgaaagttaagctgccggcccatttgattaaaagcggtcgccagttcaccgatttcatcctgagttaaaatcgggatttttgtatcgaacttgcccttcgccaaatcctgcgcgccttctctcatttttcggagagggtacgtgaccctgcttgataaaaagaatgcgaaaaatgtggtcagcacaatcgcaattccagcggcaagaaaaatatagcgggtcgtatgttttgttgtatctttaacggcaagcaaagactgggataaaaagaccatgcctttctttccgtctttttcatacgggacacctacaatcaggcgttcattatccgtgtctgtatcgctcagtcccgtccgtttgcttacttttttatggtctttgagagctttatttaagtctttgtcatgctgtatttgctcaaccgtaatagacgacaggcgatttttatcattcggagaataccagtggttcttctcatcctggatgatggcaatgcttgttaagttatcagcgagttcccaagtgattgaccttgccagtgcctggtcctcgtgattttctaggatgacagcaactttattcgcaagctgtgttaaatcattctcagcttcttccacatggtagttttcaataaactccagcaaaagaaccgttaaaatgaacaatacgatcaagacgagtgaaaggatcgtaaaccacagcttgcctactacgcttttccaaaatttcattcagcgccgacctcaaatttataacctacaccccatactgtgacaatttttttcgcagcttccggagataccttgttcagcttctctctcaagcgtttgacgtgagtgtccactgtccgtaaatcaccaaaaaactcatattgccacacttctttcagaagcttttcccgatcatacaccttgtcaggcgttttcgctaagaaatatagaagctcatactcttttggcgtcaggctcacttctgttccatcagctgttacgcggtgagcatcatggtctattgacagatgtgaaaacacgagcacatttttcgtcggtgtattggcattgaaataagaggtttgggatgctcttctcaaaagggcctttacacgcagcacgacttctctcgggctgaacggcttaacaatataatcatctgttcccgcttcaaacccctgcacccggtttgcttcttctccttttgcggtcagcatgataatgggtgtcgcttttttttcacgaatttgccggcacacttcaattccatcagtccccggcatcatcagatcaagcaaaattaagtcataattggcttcaagccctttggcaatggcttcatcaccattttcagcttcatctatagcataattttcacgttcaagatacattcttaaaaggcggcgaattctggcttcgtcatcaactactaatatttttgtttcgttcgtttggtccatgttttccccctgctttccttctgttactttcattttatcaaatcgtgagaaagtttgagaactgtgtcgctttcaaaggactatgcataagaatgaagtccggcaagcacaagatttacgaatattaaattaaacataataatagcaaaaccgattacggccagccatgctgacttctcaccgtgccagcctcttgacagtcttaagtgcaagtaagcggcatagaacaaaaacgtgatcagcgcccatacttccttagggtcccagccccaaaatctggtccaggcgagctgagcccaaatcattgcaaagatcagcgcgccgagtgtaaagatcggaaatccgattgatacggccctgtacccaacctcatccaccagatcaagattgacgtttttcaccagcggatgtaatagagcgctgattctttttctgatgatcagacggagagccccatacaacacaagacctgctccaaatgaccaaatgacagtgttcacttttctgcctgagaaaagcgcgggaagatcaacaagcggttccattcttccttcggtcaaaagctctccctgatgcggaccgacaagcgcgggcatttcgtacaccatcacgtttttttctttacttttgtccacccagttaaactccgcttcatagcctgcaagacgaaatgctgatgtgattgcaataaaggcgacggttgtgaccaggataaacataatcgcttcaagccagaaggtctttttgcttggctttgtctggtctacatgcttcaaaagaaagatgacaccagcgacaaagctgatggcaagtatagcttgcccaagcgcggccgttgttacgtgaatatacagccagttactttggagcgaaggaattaaaggcgagatatctgtcggaaacatgctggcgtaggcaatcagcaataaagcaattgacagcgtaaacaggcctaatgaaggcaatctatagagaaaataaagaatgataaacgccaaaacaagcatcatgccaaaagcggtggtgaattcaaacatattgctgaccggcgcatggccgctggcagcccaccttgtgatgaaatatccaaggtggcagaaaaaaccgacaatagaaagggtgattccaatgttggcccatcggtttggcctgccctttttatctttattcccgcgtatggccccgccgaagattgggacagcgattaaatacacaagaaaggccgcataaagaaaatttccgctcagctctgccatgacatcactcccttttcgcctatttctgtgttttgattaattctttttggtccaccggttcagtcagtccggaatcagccaatataaatgctaaatccttcttcaggccaaaccagtttttattggtatgccccgctaccataactgcaccgtcctgtgagtgcagccaaattcttcgatgctgccagtacataccttgaataacaccgatcataaaaatggctccgccgacagcaagcacccagagtgtcagatcctttctgactgtaagtccagtaatgtttttcgtttcgacatggtcaaatttcagcttgtatttattattgcctgatccttcgatggtttcttggatggcgacaaagctcttttcgcctttcggtttgtccggcgttatgatattaaagacaaaagccggattgttagggatctttgtttttgtgctcggctctccgtcctgattaaagtagaagtctggcaggtagctggcgatttccaccttgtaaccgttgccaagatcatagaccgaatctggatccagaaggttgatcttcaggctcccaaaggatttttttgtttttttatcaatcagctggaacaccatttggtcaagctgattctctttgtaatccacctggtaaacggaaaaagaatcaaaacgcagcggctgattgacacggatgtcttcttctgttacttttttcagcttcggcttctcgccataaacaattttcccttctctcttgtagagtacggcatcggtttgaaagttctttgccactctaccgtccccgactctgtcaatggcatctgcaaatacctttttttccgttttgctgttataggtctctacgctgaattgattgtttttcaaataatatttcccgtctgtacccggaattgctgcggtttcgccttctctgacccaaagcgtctcatcgacatacatgccaggcacaaatctcagcatcgcaccaaccagaaagatgattaatccaatgtggttgacatacgggccccagcgggaaaagcgtcctttttcagcaagaatgctgccctctttttctctgattctataatgttttttctttaatagagcaactatcttttctttcgattccccgttcagtacagtaaccgtttcactgaacaagcgctgcctttttaaaaaagccgggctccttctgacgccttggttttttaacgctctgtacaacggaatgacccgatcaaggctgcaaatcacgagtgaaatgccgatcgaggcaatgagcagcaaataccaccaagaaccatataaatgatgaaaccctagcaaataataaagctggccgaacgtgccatactgctccttgtaataagtatcagcctgtgcgcccggaggcagataggcttcctggggaaaaatggtgccgaacgctgatgcggcaagggttatgacgataagccatattcccaccttaaccgaggaaaagaaattccaaattttgtcgataatcgttttgttataggtttgcgaacgtcttgcgcttccgtcatatctcatatcagcgagcggaggttgagtttcctgaagagctcttccgcacgattcgcataaaacggttccaaccgggtttatatgtccgcattcacatttgacttgcttcatcccgaagtctctccaggttttatgagattcatatattcgtgtatcatgctttctgtcatagtgccggtcaccaccttgacaacttttccttccggattgatcaaaaaggttgtcggaagcggagatacgtcataggcatcaagcacttggcgatctgtatccagaacaaccgggaaattgactccgtaggatttcataaaattatgtactgctatctttgactccccaacatttacagcgacaatttcaacaccttggcttttaaaatgcttatattggtttgccatataaggaaactcttttttgcacggttcacaccatgtaccccagaaattcaaaaaaacacctttcccttttaagtcactgagctcgatacgtttcccattcgtatcctcaaggacaaaattcggtgcgtcggacccttcggatatactctctttgccggcaaatacagcgttgtaaatggtatagccgagtgcgcagattaaaacgagaaggatgccggtccgaatgaataaacgcctttttttcttcattgtccactgcccccttccccctattgcagatccattcaattatatcattgcacgttcatttcacatttcttactttttgaaggttatgtgaaatttagaaagcgtttttaccgtgatccgccagtgctctgagcctttttacttcgtgaggcgtaagctctctggcatcgcccgtgtgcaggcctcgcaggtttaaaaacgcgtattcctcacgcttcagcttgattacctcatgtccgatcgcttcaaacatgcggcgcacctgtctgttgcgtccctcatggatcgtcagctgaataatgcttgtctgctttttcttatccaaagacagcagcttcgctttagcaggcgctgttttgccttcctccagcctaattccgcgctccaactttctgagcagctctttaggcgggattcctttcaccttcgccacgtatgttttgtctatttcatacttaggatgcattagcttattggcgaattcgccgtcattggttaaaagcaaaagaccgctcgtatcatagtccagacgcccaatcggataaatgcgctgcggaatatttttaaaaaagtccgtcaccactttgcgtcctttatcatcttgcgctgcggaaataacgcctcttggtttatataagagaaagtaaaccggctcttcgcgttcaacctttaacccgtttacctcaatctgatcagaaccggtgaccttaacacctagctctgttactactttgccattcacctttacttttccttctttaatcagctcttctgcctttctgcgcgacgcaactccggcatgagcaatcactttttgcagtctttccatgtctttcacctcaagtattatcttacttttttcaaccttaacaaacaagctttttcaaattcctatgccaaatctaaaaaaaacgccgttttcaggcgctcccaaataataacgtaacgatgatgatagatgcaactacgccgattaaatctgcaagaagtcccacctttaatgcatcacccatttttttaatgccgactgctccgaaatacacagtcagtacgtaaagcgttgtatctgtagatccctgcatgacggaagccagcctgccgataaaggaatcgggcccgtatactgcaattaaatcggtcgtcattccaagtgcggccgtaccggagatcgggcggatcagagcaagcggcactacttcagcagggatgccgatagcggagaaagccggttttaaaagatccattataaaatcaagcgcgcctgatgatctgaaaacagttatagcgacaagcattccgactaaataggggataatggaaaaggcaatttctatcccctctttcccgccttcgacaaacgattcatatgtgggaacctttttgatcgttccataaagaagaattccggcaataatgattggaatcatggctaaagacagccagttgatgatttccatccgctcaccttcccttctttttgcggcggtaataaaaataccgatcaatgataatggcaccgattccggaaataagcgttgccaaaatgcttggcccgacgatatctgtcggcgttttggaggaataagccattcggacagcgatcaccgttgtcgggatgagtgtgatgcaggacgtattaacagctaaaaaagtaatcatcgaccggcttgcttccgatcggtttccgttcagctttttcatttgttccattgctttaatgccaagcggagttgctgcatttccgaggccgaagaaattcgccataagattagataaaatatagcccatcgccgggtgatccggcggtatatcagggaacagtttagatataaaaggtctgcacatccggctgaaaatatccaaaagccctgactgctcggcgattttcattaagccaagccagaaaacaagcacgctcatcaatccaaatgagatcgtaatcgcttctttcgcacccttaaacacggcttcatttacatcttgcagagttccgttgcacatcgcaaaaacgagtccgatcacggttaaactgacccaaattatattgaccattttgctccgcctgccgcattcagaaagattgatttaaacgtttcaaaaaattgtttcttcggtttttgatgccgctcattttcataatagatcggcacttttgcgatggttgcatcgttgaacatgatctccatgtgccctacgatgtcagggattttcgaggcatctttttcccatgcttttttcggcttgagcagtgtggtattaatttttacattttctttttcctcttcggtcagtaaataggtgatatcacgtttgataaaagccttcgattcataaaatgtgcctttcagctttggaatatcccctttttttgcaattaaataggtttgataatgctcaaacacatagttaaacatcttcatatggtcatcccaatcattagggtcattaatggtgacggctatcaggtcaatgccgtcctttgaagccgtagagaccagtgtccgttttgcaagttttgtatagcctgtttttcctcctgtgctgtacggataaagcatggtcagcagtttgtttttgtttttccatacgctttccatcgtttccgctttgtatatttttgtgcctgaaatcttttgatagtctttcagcttcatagcatacttagttaaaatggccatgtcataggctgttgaataatgattttcatggtcgtccaatccgtgcgggttttgaaaacgggtgtttttcataccaagctgctcggctttttgattcatcatataaacaaacccatcgaggctcccaccgacatgctcagcaatcgcgacagcggcatcgtttcctgatcttagcatcaggccatacacaagatctttcagcttcactttttgaccttctgttaaataaatggcggagccttctgttctgacagcatttgccgaaaccgtcactgtttgatccattttgccggattcgatggcgaggacggcggtcataatttttgtgatgctcgcgatccgccttttttgatgctcatccttggcatataacactctgcctgacgcaccgtcaataatgatcgcgctttttgcactgacatctatagcagcatgtgctgtattcacatttacggttgcaataagaaaagaaatcatgatcacgaatactgcttttttgaaaatgcgcatgtttgctcacgtccttgtggtggtttgtacaagtttatgcgcatgtccatcagttatgaataacaattatatttctggaagcaaacataaaaaaactctccctgaaaaagggagagtaaacgttatctgattggcgccatgcttgatccggacgcttcgtaatgagccagctcttccctcatcttcagaaaggccgcgctcaacggcaataataattgctcaagcgacgcaggaacagcatgataaaactcaattgcgctgaccccggtataagacgcccggctattttcacaccacgtgtcttttttcggcataaagaactcttcaatgcattggtgatacacattataaagtgttttttccgctctggcttcctgaaaaggctcctgcatcaggagacgacggcacgcttctgcgcctccttcacaaaatactgccattcttctcagagtgctaagcacatcacagcagtatcctttttcaataggcaattcagcctgtaaggactcaagcgtcgtttgatttaggtaatcgttcacggtattgacaaccattgataagaattcgcctgttttttgagtctgcgctcgcacaatcgaatgtcccatttcgtttggtatcttcccctcatgtctttgtctctcacattttgcttctttcatgatagcttcttccttatatcttatgatgatgaaaaagcgcgattcattaaacttctattttatatcttcgaaggtttggttaaagttttcaaaaaataaatctgcttcttcttgaagaacgtcttcttccgcattttcaggcagcggcggaagctcgtccagcgttttcaggccgaattgttcaagaaaagtcggcgtagtaccgtataaaatggcccgccccggaccatcggcacgccctacttcacacaatagcgccttcgcgacaagactgtgtaaaatccgctctgattttactcctctgatttcttcaatttctgctctcgtaattggctgtttgtatgaaacaatggccagtacttctaaagatgcttgagaaaggccctttgacggcacttcaatcagttttttcaagtaaggcgcaaagtcttttttggtagagagcatgtacgtatctgcatactcaataagttcaatccctcgtgtatctccgcggtattcgtccgccacatccgccatgatcgtgttcagttcaggctcttcgatttcaagcactgttaacagctgcttttttgtaagcccttcatcgcctgccgcataaagaagggcttccacaatagctttccaattcacgatatcaagccccatgaatggattcactccccgtaatgtaaatatctgaaaaattgtgctcctgttcaatgaggaccagctgatttttcatcagctcaagaacagctagaaaggtcactactaaatgttctttttgttcatatggaaacagatccataaagttgattctcgttcctctagatttcaagctgtgcacgatttcgttcattctggcttcgattggtatgtcctgtcttgtaattgttgtttccatcggcctgtttatttttttgcgtttcagcactttttgaaaagctccgatcatatcatagaccgtgacagagagcttttgctcagactgttttacttcttttgcatattcactcaaatcactcggcggtttcgtgaacgatttttgtctttcttcttcccgttcttttaaatccttcgccgcatctttatattttcgatactcaatcagcttttcaatcagttcctcccgcggatcttcttcttcaagtaattcatcttcaaaaagctcctcctcttgcttcgggagcagcattctgcttttaatgctgagcagcgtggcagccataaccaaatactcgctggccatatcgagctcaagcacacgcatcgtatgtacatataataaatattgttcagtgatcttcgccacaggtatatcatatatgtcaatttcaagacgattgattaaatgaagcagcaggtccaatgggccctcaaacgtatcaattttcacttgatattcttccatcatctcaccattttcaagtatcactctcattgccggaaaaactggctaccctatagtataagccaccaaaaagctctcgtccaatactatttcatttcctgttttgaacaagtttgtacagaatattcaaaacacgagaggtgtttgctcggagcgcagaagcgggagaaaaagccttagcttctggttttcctttctaagaagcaatagaggccgagcgttcttttttccttttatcccttctatggtacactaaaagcacattaaaggaggaagcaccttgtatccgaaagcttatatagattatctcgttgagtttcacgcgacacgggattattttgaatgccatgaaatattagaagaatattggaaggaagatccgccaaagaaacgaaaacgctattgggtgggctttattcagcttgcagttgctttatatcatcacagaaggcagaatacagccggggcaaaaagactgatggcgaacagcatccggattcttcaagcagaacaccgggcagtcgaagacttagggcttgatcatggccgtttgctcgaacttatgcaatcggtttacgaacaaatcgaaaccggctctgcctataaaagcattatgctgccaatcaaagatgagaaactggaggaagcatgcaggatcgaatgcaggaaaaaaaagtatacatgggggcagcccagtgcactcaggaacatatttcttatcgacaaacatcgtttgcgggatcggactgacgtcatccgtgaacgtgaaaaagaaatagaacgcagaaaaaaaagcagagactgatcacagcctctgctcagcgtgtcgacaaaccctcgcattcgttgtcaagcctgtgcgttggtgctcacgaatgaaaacattcgctccgctccaatgctcagctttcctagacttcaagggttttcaatcgcgctgaaaggatgacaaaaacctaaaacaaaactgttttcggattttgtcatcaaactaaagcagaggctgatgacagcctctgcttaattattgtatgaaatgtcttgatcctgctgaccttgacaacgttcgaaaaagctctgcgttaattcatttggaaccagtacttgcgttttgaataaatgctttaaagcatccatcatctgttttccgattccttgatggcgatgagaaggattcacactgatatgccggatctcaacctcagaatcctttttttcgactccgattgctccgacgatatcctcgtcctctttccaaagaaagagctggcggtctgtatccgtttcgtagtccttaattgtctgctgaagctgcttaaggtctttttcattcggcataaacgaaagaagccccatcgcaatcttttcaaacgattttttataacgaattaacataaaaacccctctatatccaaaatgtccagtctgctattaacggatacgaataggtgatccgttttctcacattatatcattttcgccatatttttaaactgttttcagcaaattattcaaatgagcggtttaaatttgccatttcaatggcagaaacagcacaatctacacctttgttgcccgcttttgtgccggcacgctcgatagcctgttcgatgttttcagttgttacaattccaaagatgacaggtacaccagtagtgtttgctgcttgcgcgatgccttttgcagcttcattgcagacataatcgtaatgtgtcgtcgcgcctctgatgacagtgcccaatgtgataatagcatcatatttttttgtttccgccatttttttcgcagcaaacggtatttcaaatgcgcctggaacccaagccacatcaatgtcatttgtgtctacaccatgtctgagcagcgcatcttctgctccgctcagcagcttgctcgtaataaaatcattaaatcttcctactacgattccgattttaagacctgtaccaactaaatttccttgtatgatattcatatgattcccatccttttttgtgatatttgtgattagaaatgaagtaaatgacctagcttgttcattttggtttgcaaatattttttattgtgttctttcgcctccatttgaatcggcactctttctgaaatacttagtccgtagccttcaaggcctgcgatttttcgcggattattcgtcaaaagcttcatattccggacaccgaggtcgcgtaaaatttgtgctccgatgccatagttgcgaagatccggcaagaatccaagcgcctcattggcttctacggtgtcataaccttgttcctgaagcttataagcttttaatttattgattaaaccgatgcctcgtccttcttggcgcaagtacagaagcactccacggccttctgcggcaatttggttcagcgcggcgtgcagctgcggtccgcagtcacagcgatgagacccaaacacgtcacctgtgagacattctgagtgcacccggaccaataccggttcttctccgaacggcacctctcccatcacaaatgcgacatgctcttttccatctacctcatttgtgtatccataaaccttaaatgtcccaaaatcagtaggcagcgtaatgtcaacttcacgctcgacaagtgttgtcagattgtaacggtattgaatcaaatccttaatggtgatcatttttaattgatgctttttcgcaatttcaatgagctcaggcactctcgccatcgttccgtcttcattcataatttcacaaatgacgccggctcctggagatccgcaggcttcagcaagatcaacagcagcttctgtatggcccgctcttttcaggacacctccttttttcgcaatcagcggaaaaatgtgccccggacgctgaaaatcagatggcacggatgtgctgtccagcaatgcttgaacggtaaaagatctttcttgagcgctgatacctgtcttcgtttcacgatggtctatacttacggtaaatgcagtgtggtgagaatctgtattatgctccaccatagggtgaagatcaagcctgtctgcgatttcctcactgagcggcgtgcagatcagtcctctcccatgtgtcgccataaagttaatgacttccggcgttgcatgctcggcaagagccacaaagtctccttcattttctctgtcttcatcatctacaacgatgatgacttcgcctttttttaaagcgtccagtgcttcttctatcggatgaaacatgcaaatcttcctctctaaaagccgttttcgcttaagaaggcttttgtaatggtttgttgggtcttattttcattggctttatgcaaaaatcgatacatatattttccgatcatatcgcattcgatattcactttagagccgatcgttttttctgaaaagatcgtttcgctgatcgtatgcggtattaaggagatcgtcactgtgtcttctgtcaggccgaatatggttaagctcacgccatccacagtaattgatccctttaaaaccaatgtttttgttaatgacgggtccatttttaaatcatagtaaactgcgttgcttttctcttcaattcgtgtgatttccgcagttccgtcgacatggcctgagacgaaatggcctccgaaacggccgtttgccgccattgctctttccagatttactttgcttccttttgttaaatcattcagtgacgtagctttgactgtttcaggcataacatccactgtgaattgattttttgtaaaatcagtgaccgtcagacaaatgccgttcactgcaatgctgtcgccaagatgaacatcctctaaaatctttgagcatttaattgttaaggccattgaatgccctgcttttttcatggattcgattgtgcctgtttcttcgataattcctgtaaacatggtcaccatcctattcctttgtcggttttgccgtcagtttgatatcacggccgatttgggttatatcagtaaattgtaataaggggacatctttcattgattgaaaaccttcaccggagattaagctgggagcatgcgttcctccgattagtttaggggcaaaatagaagatgatttcttgaaaacagccttctttgacaaagcttccgtgaacagctgaaccgccttccacatacaccgacatgatgccttcttccgctaggatcttcaaaacatcaggaatttgaatgcgctcggtttcaagtgtaaatatgttcactccgaaagctgaaagccgttttttcttttcctcgtctgcgcgtgccgtcgtaaaaatccatgtcggcgctatttgatcgcaaatcactttagcgtcctcaggaatcgagagtacggtatcaagtatgacccgaaccggctgttttgttacattcggcagtctgcaggttaagcttggattgtcggctttcactgtgccaactccgactaaaatgctttggtgtgttttcctgtattgctgagcatcctgtcttgcagcctctgacgtgatccatttgctgtcacccgtgctggtagctatcttgccgtcaaggctggcagccgcttttagcgtgacgtacggaaggcctgtcctcataaagtgcagaaatttttcattcaggctctccgcctggtctgccaggatgccttcccttacctcaatgccggcttctttcatcatgctgatccctcttccagccacaagcggattaggatctctcatcgccacgaacactcttttgatgccagagttgataatcaattctgcacatggcggtgttttcccgtaatggctgcacggttcgagtgtaacgtaaatgtcggcaccctctgcatgtgctccagccatatggatggcatgaacttctgcatgagcttccccatattttaaatgggcgcccattccgacaatttgtccgtcctttacgacaacagcgccgacgagcggattggattcggtctgtccttcgccctgcttcgcaagatctaaggccagcttcatataatactcttccatttgtttccctcccctcttttgttatttaccgtcaaaaaagccccgaatttataaaaaattcggggctttaggtattttacgcaataggaaataacactatgcatttttgaaccatttgcatagcggttcatcatccttctcccatccagactttcactgtcggcttcagcttaaactgaatccaccgcgtgcttatgcacacgggtcacgggctctaaagcaaatgtgctttactaccgccggtcgggatttccaccctgccccgaaggatacaatctttattcatttgtccttattggctattatagcgatcctttttaaagtacgcaatgaaataaacttacaatttgagaaaaacaaaacatcacccttcgatccgaaaggtgatgttttgttaatcattcacttttgcaaccttgattaatccgtcgatccgctttgatttgctgaagtatgccttaatcttgtcaccttcttttatatcagataaatcctgatttaatttttttccgttgaagatgattttcgttccgttttctgctactccatgatactctgagccgtcaattttcgtcactttatattcctggatggtgtattcctcttcttccgaggacaaggtttgtccaattgctgtcggaacatccttcagctcaacgtcatttatgtacatataaccgcctgcaagtaaaagcaaaagcactaacagaatggtaatcttggtttttattcttcccatttctaaacctccagccaatatgaatctattcattcatatgagttattcctttttttcatgaataaaaaaccgtaaattctcgtaaattattaatataacgatgcataacgggaatatgtttcacatttctgcaaaaatttcttttctatagatatacgaatttatgttctgttttaaggggatgaccgcaaaaaagatataaaaaagcagcctctcgggaagctgcttgatcctaatttgttttgcgcatttcgttaaacgggtagaaaacaaactttgacgtacccgcaatttgttttttcgtgaagaggccaaggccgttacggctgtccatggaattgcgacgattgtcacccatcacaaaatacttgttatcaggcactttaaccgggccgaaatcatcggtcaaatggtcaaaaccgtcctgtttcgctctctttttattagccgccaaataaggttcgtccacctttttcccgttgatatagagctggtcatttttcatctcaaccgtatcgccgggaaggccgataatacgtttgacatagtgaacatcatctccgtttaacacgacgatgtctcctctatcaaactcgccgatgtatttgactgtcatattaacaaaaaccctttcacggttgtgaagtgtaggatacatagagtcaccatcaacgacatacggcgcaaaaataaagttgcggatgagcaaagcaagaacgacagcaatcacaattgcttttgcccattctaatattgactttttcttcgaaacattttctgatttcaactgatttcctccaataaacaacggtcttcaatttatgttatcacgaatcgaaaaaaaatcccattaggaccattgaagtgattttacaaactgttaatcttcatcttctacccacatcatgcctattttttcttgtcgatcataactaggcctgaaaatattgaaagaaatgaatcgcataattcagaagcgatggactcagaagaaagagagttctcatatgcaaaatctttagatcgtatataaagcatgaggttacgggcagtttgttcatttactgcattccattgatctcccagtccatgatacccatggcacttgacaaaacaattaacgtcatgaaggttactggaatgtttgcggcaacctatttcacaggtgataaccgcaccccgttttttgctttcataatatgtttaaaatcattcaagctcgaaaacatggatcagcctccaaaaaataaatccaatatattcccggcagttgaagactctttattataaaactctgaatatccgcagttcttacagtaaaccactagaaatcggttatgctgcacgtcaaacagctttgataatcccgtgccggttgtggctatttctttttgtccggcttcagtactgccgcattttatacagcctttgttgtccataccgcgatctccttttcattacatcacgtttgtttgatttattttactacaaaataccaatcccaatgaaccgtactactttaaagtttgcttaattttgatcccccgttctttacatactaattgggttcgtttctcagcttggtaaatcttctggagaaacggaaaagctccatgaccaaaacatttaaacccagccaaacaccgccgaaggcgcaacccgcagcaacatcactcggatactgctcattaacgcgtacacacgatcagcccgatgaggaataaaacgataatcatcaaaaaacgcaacagtttgcagacgagccttgtgagaatgacgaacaaaaagataagcacaaaaaccaaaaatgacaaatgccgttaacgtctgttcgctcgggaatggatataatacatgactttccaaaggagcgtgaacaggatgaagggaatgaaagagccgtctaattccctctccataaagctctcgcaccaacgactaggaaaaataagaaagagagttcgattttccggtcttgccctttgaatactgtccaaagaaaagttagaacaataactgctaacagaacatctctagacgcaaaagctttctgaattgcagctgggcccagtctatacccgatccaatacgacatgctcactcccgcacagctccccaatccggccgctaacatgcttagcacccagtttaacttttcttgaaacacgagaacaccggcaaactctcctggtccaagtaaagatagaaactctaacatcaagacaataaacaagacggcatatccgtactgttcgagcaaccccgtcaaaacttgcatgtcattctccttaaacttttttgttcttttatcattcccaatccactttttgtataatcagcacaatttcaccttcagtcgtccaacaacattgtctatggcgggatcttctctcctatactcgtcactcatacattcttttttgacataggaggagcaatagcatgaaatgggaggaaacaaaagatacacagggagtttgccaaaattttgggcagttcgttctgccaccgagtcaggtgtttgtttgcctacctcattccttggccattccccattttccccgtttgaggttcgcaatgataaagtatttcacttagtttcgtacatgaagaggtaaattctttgctcaccgaactatgatagctgcgcatgatgattactgcattgcataaccactggttatttagtgagccgtgagcaatgtatatgcactttgagtcagcacaggatgatcctattacattcgccagaaaagcagctgccgcattcagagtagttaaaagaatagacagatagctgggcttccggaaggaggcgcttttttcgagcatttttataaatcaataaaaataggcatcttctaaatatttttgccgataagtttacgctaatcaactctagcactaatacatataaacaatagaatgatatgaaaggagacttaatagtatgattgattatcctattaatataaacaacgtttccgggaacagtgtaattaacgtaggcggcgcttttatgatcaggcctttaactttgtccaaatctgtgtttggctccggaggtttaaatacaggaattgtctttgaaaataactttgtaagcaaggctaaaatgattaatcatcaatttactgatcaaaacgtcaccaaaactttttaatctattcattacgggggcttgcgatgtctcactaactaaacacctggttttgccaaccgccatcagcactcggcggttttttattgaacatttttacccaataaaaaagctccctctatatgaggaagccttttgcctgccaattagccttctacgcgaacttctttcatgacatcgccgttagacatgtttttcgcgaattctaatccgcttgttactttaccgaatacagtgtgaacaccgttcaaatgaggctgtggctcatgaacgatgaaaaattggctgccgccagtgtcttttccggcatgtgccatagaaagtgcgcccgcctcatgtgtatgcgggtttccttctgtttcacatttgattgtgtatcccggaccgccagtaccagttccgtgcgggcagccgccttggctgacgaagccaggaatcactcggtggaatgtaagcccgtcataaaagccttcgttcgcaagcttttcaaagtttgcaacagttccaggtgcagcttcaggataaagttcaaattcgattttgttcccgtcttctaataaaaagtaacctgttttcaattgtatgcctactttctttattttaattttcaaaggagattatgtatgataggttatagcctgtctctccttgtcgcggctattataccacacctttcgggggaaaacgaatctcccgggctttactaaaaaataaaaatgaaacctgaatctctttatctccgtctaacctaacggaactgtatttttcatgattcaggtcctcacaaagcagcactatccagctgcttgtgaaattgaaggaggtcaaactgctttgaagaaaatttggattggaatgctggcagcggccgttttgctgctgacggttccgaaggtcagtctcgcggatgccgcagttggagatgtcattgtaacactgggtgctgatttgtcagaatccgacaaacaaaaagtgcttgatgaaatgaatgtccctgataatgccacaacggtaaccgtgaccaataaggaagaacatgaatatttaggaaaatatatatcgaacgcgcaaatcggatcgagagcgatttcttcatcgtcaatcaccattgccaaaaaaggctccggattgaatgttgagacccataatatcagcggcatcacagatgaaatgtacctgaatgcactgatgacagccggtgttaaagatgcgaaggtgtatgttacagcaccgtttgaagtatccgggactgcggctttaactggattgattaaggcgtatgaagtttcttcagacgaagcgatctcggaggatgttaaacaagtcgccaaccaagagcttgtcacgacatcagagcttggagacaaaatcggtaacgaaaatgcatcagccctgattgcaaaaatcaaagaagagtttgctaaaaacggggtgcctgataataaagctgacatcgaaaaacaagtggacgacgcagcttctgatttaaatgtcacgcttacagacagccaaaagaatcagcttgtctccctattcaataagatgaaaaatgctgacattgactggggacaggtcagtgaccagcttgataaagcgaaagataagattacgaaattcatagaatcagatgaaggcaaaaacttcatccagaaagtcattgatttcttcgtatctatctggaatgcgattgtatctatattcaaataggaaaagcgccgaaaaatcggcgctttcttttattgctttacacccgttttaaatggcagatcaagttttacaatatcttcgtatgtttctcgcttcacgactaaatgagcctcaccgttttcgacaaatacaacggcgggtctcggaatacggttataattgttggccatgctgtatccataagcgcctgtacaaaaaacggcaagaagatcgccttcttttacttccggcaggtcaatatcccaaatcagcatatctccgctttcacagcactttccggcaattgataccgttttgtcatgcgcttctccgatcctgttggctgccgcagcttcatatttagcttggtaaagcgcaggacgaatattgtcgttcatgcctccgtctacagccacatattggcggacacccggcacttctttttgagagccaatcgtataaagagttgtgcctgcgtctcctacgagagaacggcccggttcgatccaaatttccgggatgtcaaaaccgtaacgggaagcattttctttcacagcttcgataattttttcaacgtattcagtggcatgaagcggttcatcatcttccgtataacgaatgccgaaacctcctccaagattcagcaccttggatacaaatgaatatgaatctctccattcgtctagttttttgaagattttttccgctgctaacacaaaaccggccgtatcaaagatttgcgagccgatatggcaatggacacccagcagctgaatgtgttccgattgtaatacttgttcaatggcccgttcagtttgtccgttatgaagatcgaaaccaaactttgaatcttcctggcccgttgtaatgtagtcatgcgtatgcgcttctactccgggcgtgatccgaagaagaacatcgatggagtgacccgtttctttacataggtcttcaagaagcgcaatttcatagaaattatccaccacaatgcagccgatgcggtgctcaagcgccatgcgcagttcttccctgctcttattgtttccatgaaagtggatgcgttctgccggaaagcctgccgcaacagccgtatatagctctcctccggatacgacatctaaagaaagtccctcttcctcagcgagctgaatcattgcgactgatgagaatgctttgctcgcatatgccacctgtgctttcagccctgcagaaataaacgcctgtttaaagcttttagcacgctcacgtattaaagccacatcatatacgtaaagaggtgtaccatatttctccgctaaatagagagcatccacacctccgatttctaaatgaccatgttgattttgtctgcttgtgccgtgtaagaacaatgtcattccctctttctccgcttatggatgaaaggacagttttatggactgtcccttcataattaagacatacattatcatactcttcagtcagtttcaatgcgattatgaattggtaggctgtcttaagcgatttttggggtgaacgatactgggtcttacttttgcgccaggtttcgctgtgcggacaagaacctgccacagcgcctttccgttaaagggaatcagcggccataagtacggtgtctgaagggatttgatgcttgtcatggcaataattagcactgtaaatccgatgacgagcccttttatatgaaataaagcaacgagtatcatgaggacaagacggctcattttgtttgccaagcttaattcataactaggcgtcgtaaaggttccaatcgccgcaagtgagacgtacagaatcacctcaggagaaaaaaggccgacctcaatcgcaatctgcccgatcagaacagcggcaattaaacccattgctgtcgataaagccgtcggtgtgtgaatggcagccattctgagaaactcgattcctaagtcagctaaaaatatctgcaggatgatcgggatatgcgtatctttatttaaaccgataaatttcatgttgtccgggagcagatcaggctgaagcacaaagagaaaccagatcggaagaaataaagtagaagcaagaataccgaaaaatcttacccatcttaaaaaggtcccgactgaaggcgcctgcctatattcttcagcatgctgcacatggtgaaataaagtcgtcggggtaatgatcacactcggcgatgtgtccactataatgataacatggccttctagaacatgatttgcggccacatccggtctttctgtatagcgcacgagcggaaaaggattatagctttgattaacaatgaattcctcgacagttttgtctgccattgttaatccatcgacatcaatggatgcaatttctttttctacgatctcaaccagatccggatcagctatatcttctatataacaaatgcttaaatccgtctttgaccgctcaccaactttcgtcatcttgactcgaaggcgttcgtctctgatccgccttctgagaagggccgtattgacgacgatattttcaacaaatccgtctctggctcccctgactaccttttccgtatcaggttcttccgggtttctgcccggatagcttctgacgtcaattataaatgcgaaacctgcaccttcaacaatgacagcgacgagcccggacagcacttggtcggtggtttcatccaatgtttttactttttcgacctgggcgttcagcagcctgttttcgacgatgtcgaccagctcatcagggtcttctttccgattgttaatggcaacaagttctctcattaaatgaataatataggctgtatcgcataatccatttagatagtaaagctggatctctttatctaaaatcgtgagcttgcgaacacctacatcatagctcgtccccatcccgacacggtttttgaaatactcttcatttttagctggattccgataaacccgaattttctcttccttgtggtccggcatgatacccgctcctttctaaaataaactcgaccgctttcatggtgattggcgacccttttgagatatcgtcttttctgcccattttgccgatatccccgataccaacaataagcgggagatcaagtttatcaaggcaatagactgtatctccactcattctgtggtcatcaaattccctttccccgactttatcgacgccgtattcagttatttctccattgcggtcaatgcttacatcgaccctggtccattcagcctgatgtgtttttgacgcgaccgcaatcacaccgagcacttcaatagacggatgggttgcgacataggtcagagcggcttctcccggaccctctccttgaaggccggagtcgtcaaacatgacaaatacaggatcatacggtgctgaggcgatcagcttgacaagctcggcgccgctgcgggtggaaggattcccttttgattgtgaaatacatcgacctcccactttgcttgcggcgtattcaattgttttagcggcataaacatccccgtctgttaccagtatgaccttgcgttttgtcgtcatgtcggcattatcctttcggtttgaaaataacagctacgataaaggcgaaaagaatagcggctgagataccggccgaggtcagctcaaaaatccccatgccgattcctataaatccgtgtatatgcgcctgatgcatagcaccgtgcagaagactgtgaccgaagctgacgatcggaacggtggcgcctcctccggcaaattcaataaatttatcgtaaatgccgaaaccatctaatattgcaccgattacaacaaatgatgtcatgacatgagctggcgtcaatttaaaaatatccaagagcagctggccgacgatacaaatggccccgccgcatacaaaagccaaaaggtagtccatgttaagatgcacctcctgcacgctcaaatacaaccccgtgggcgatagtcgggatggtttctttttgctggatcatcgtcgggcttaacagcgccccggtcgccacgacaaatacacggtttaattttccttctctcagctgcttaaaaatatgagagtaggtgacaaccgctgaacaagcacagccactcccccggcaaagacctgctgatccggagtgtaaatcagaagcccgcaatcatcatgctttgtgccgactggatatccatcttcttttaagatgtcttttacgattggagaaccgacgcctgacaggtcacctgtcaggattagatcatagtcatccgctgtccggttgagatctttaaagtgctgcttaatcgtatcagctgcagccggagccatagccgatcccatatcaaaaggatctgtaatccctaaatcagaaacctttccgacagtcgcacttgtgatttggatatcacccggtgtctgactgatgacaactgcaccgcttccggttacagtggaggtagcagtgtccggtttttggcctccgtattctgtcggatagcgaaactgtctttccgcagttgcattgtgactgctggtggcagcaagtgcccttttggcaaacccgccatcaactaaggctgatgcgacagccactgtttccattgatgttgaacaggcgccaaacatacaaagaaatgggattttcaagtgtcttgccacatagttagccgtcacgttttggttcagcaagtcgcctgccagcaataggtcaatatcatcttttgtcagattgtttttttgaagcgcaacattaacagcgtcttccatcagctggcgttccgccatttcccagcttttttgattacaatgcatttcgtcataggttttatcaaataacgagccgagcggtccgtctttttcctttggtcctgctgccgttcccgctgagttgacaaatatgggatgttcaaatacccaggtttgctttcctgttaatttcattttcttctcctcctatgacatcagtttctcaaaagcaaaccgaatcattccaacgatgtatgcagctacaactccgaaaacaataacatttcctgccagtttaaacatatttgtcgctactccaagcactaatccttcacttttatattcaagagccgcgcttgccatactgttggcaaaacctgtgacaggtacggctgaacctgcgcctgcgaattgtccgattctgtcatagatgccgaaccctgtaagcagggcggaaattaatatcagcgttgcagctgttggattccccgcagttttttcattgaaatcaaaaaaatgaatataaaaattttgcagaccttgcccgattgcacaaatcagtccgcccactaaaaaggcttttacacagttccagacgtaaggcggcttaggctgatatgttttcacttttgatttgtaattttcttttatgtttgtcatcttgaaacctccttatgaatggtcaataaagtacagccaatgaaataaggatcccgcgattttcccaatcacgatggccattaacagaataatgattttacttctgagcccgattcgttttgccaaaatcggcaggacatttaaaacctctgtaagagcagccgctagcatcccgacgaacaaacctgccagaagcccgaccggcacagctatccattttgttagataaagatgattcatatgaagcgtctcccatcccccgcaaaccgcgccaagaataacagccgcttcataagcctgaacaaatctcattgttttggtgagctgcatcagccgcggaatgattcccattacggttaaaaaagcaacgaaacccgcccccaccgttatgcctccgccgagcccgacaaaaataatgaacaatacactaacgatcatgcagatcctttatggtttcttgattctcatgcatggccacatattgatcgagatcaagctgatagttaaacatctcaacctccagcgggctgggctcttcatttaggcgctttttaaatatgtggttaaaaaacacgatcatccccagtcccaaaccgatgctgtatgggatttgaagcaaatatggatagtcattcctctctccggttatgatttcatatagtgcgatatgaacatctctcatgcttacatcctcatgaaagttcatgatggcaagacacgatccaataaacagaagcagccagacaccgataaatagaaccgttgataaatttcgctttcgatattgaatttcaacaatggtttctgctccgcctacggtttgaacatcaagtgtcggatcttgtaaatgaatggctctgaggacttgtatgatatccagaattacgatatttttatctttttcgctcacctgataaagcggcatagccgaaagtttctttttcagctgaagctgcccttctatttgcgcggcatctccaacggtaataatatcccctggatgtgccagcacccggtggcgaagccggataaatattcgtcgttccatcattgatcaccatctttcggtggttatatatgtagtatgtggttcgattttgttctcattcatccgctcgaaaagaccataaattaccacgcttttgcacataaaaaagctagcctgcactgcagactagccatccgtatgatccatttgaaccttgatctgttttaatattttcttttcaagcctggaaacctgcacctgagagatcccgagccgctcagccacctcggactgtgtctggtctttataatatctgagatagacgattagtttttccctttcctccaaatcgctgattgcttctttcagcgcaattttgtcaaaccatttttcttctgagttgtcagcgatttgatcaagcagggtaatcggatctccgtcattttcataaacggtttcgtgaatcgaagatggagcccttaccgcctcttgggccagtacaacatcctcagcttcaatctccaaatggtcagcgatctcctgcaccgtcggcactctgcccagtgttttcgaaagctcatccttcgcgcgccggattttgtttccaagctcttttaatgatcgtgatacctttacagttccgtcatcacggataaatcgctggatttctccgataatcatcggcactgcatacgttgaaaaacgcacatcataggttaaatcaaatttgtcaacagattttaacagcccgatgcagccgatctggaagagatcgtcaggctcatatcctctgtttaaaaaccgctgtacgacagaccaaacaagacgcatgtttttttctatgaggaggtctcttgcctgctggtcgccattttggctttgtttgattaattcctttacttcatgatccttcagctgagcgtttttgccgtttttcttaacctccacatccataacaaatctccttaattacaaagcgctttgctttttgataagtgctttgttaagcgaatcgttgttcccatttcaggcgatgaatcgatactgacatcatccatgaaattttccataatggtaaagcccattccagagcgctcaagctcaggcttagtcgtaaatagaggctgacgggcttcttcaagatctgtaatgcctaagccttcatcacgaatagtcatatatacgacatgatcttccagcgtcactgaaatgtaaactttcccttcacagttctcttcatatccatggataattgcatttgtgactgcctctgacacgactgttttgatttcagtcagttcatccattgtcgggtccagctgagctataaatgaagcaactgtcacacgggcgaacgattcattctgactgagggcagaaaactcaaggtgcatttcatttttcatgatgccacccccagtgtcaggagcgcctgctgttcagattgttcaaatcggataattttaaacagacccgacatatcaaacaatcgcttcaccgcaggagagatagcgcaaacaaccatttctccgccaatttgcttaatttgcttgtatcttcctaaaataacgccaagccccgagctgtccataaaggaaaggtcctccaagttcagcacgatatggcgaatatcatccttctccaatgattgagtcactttttgcttcagggtttcagccgtatggtgatcgagttcgcctgttaatcgaatacaaagcacagattctttgacattcatgtcaattccaaggctcatgctcattcctccttgatatgatcggataatgagtgtttcgatttcgacggaatgaattccttcaccgtgacaaaactagtggtcattcggcataattacttaaattttgtccagtctcccatcgtccgctttaagaatgtgataaacccggctttcttcatatcttcttttgcagcaacaggactttcagcgagtacttctccatcctttttcagaacaagagtgccaagctcttggcctttttgaatcggagcactaatattgtccttcatcttgatttcttttttcacatcgttcatatcctcgccttttttcgtcaatattgaaatcggctcagatgtagtgagttcgatcaatttttgtttcccttttttgacctttacttttgctactgtttgatttcgtttatataaaggatgcgtttcatattgactaaaggcgaagtcaagcatttttgtcacttgcgcgtttctttctttaggcgtgctcgctccgaatacaaccgctatggcccgcatgtttccttttttagccgaagcagtcagacaatatttcgcttcgcctgtatagcctgtttttacgccgtctacaccaggataaaatttgataaggcgatttgtatttacaagccaaaactttttatctgtattttcacgcagataatcttcatacgtgccggtaaacttcgtaattgattcgtatttcaataattccttagccatgattgccatgtcataagcagagctgtagtgtccttcctcggtcagtcctgttgggtttttaaaggatgtatttttcaatcccagctcttttgcttttttgttcattttcttcacaaattcttcttcagagccggaaataaattcagccatggcgacggaagcgtcatttcccgaagcgattgcgatgcctttcagcatttctttgacagtcatttcttcgccgggctcaaggaatatctgtgagccgcccattgacgccgcatgctcgcttgtacggactttatcactcattttgattttgcctttatctaaagcttccataatcaaaagcatcgtcataattttcgtcatgcttgcaggcgccagtctctcattgctgttcttgttgtaaagcacttttcctgtgtcacgttctatcagcaccgcagacttcgcttcatgagcaagctccgatgtacgttttccgtcttgttttgcaaatgcagacggtgcaaatgtaagcagcattataccaatcaacaaagtggataaaagacgtttcatctcaaaagccctccatttcataatcctttttattttttccaagcgggatggttttatacgccactgatggaaaatgtttcgaattttgggcgtaaaaaaagacagctgtgtgatatcagacacagctgtcttttggtcctgcattgattcatttttattcgtactgagcgacgatcgctttaacaagctttaagaatccagcttttactttttcggtcacttccataacttcatcgtgacttaaaggctgatccagaattccggctgccgcgttagagatgcaggaaatgccaagaacccgcattcccgcatgattcgctacaatgacttccggaacagtagacatgccgactgcatcagagcccatcgttcttaagaaccggacttctgccggtgtttcgtaagaaggtcctgtcacagcagtgtacacgcctttttgaattgggatattaaggtctttcgcaatcttttcagccaggctggacagatctttgtcataggctgaagacatatctggaaatctggcgccgaaatctgcttcgtttggcccgattaacgggtttgttcccataaagttgatatgatcggtaataatcattaagtctcccgcacggaattcagtgttgacaccgcctgcggcatttgtcacgatcaacgcttccacaccgagcgctttcatcacgcgtacagggaatgtgactttctccattgagtagccttcataaaaatgaaagcggccctgcattgcaatgacggaaactccttcaagagtgccaagcacaagctgtccggcatgcccttcaacagtagataccgggaattcaggtatatcttcatatttcagcttgaccggattttcaatttcgtccgccaaaatgccaagacctgagcctaaaataaggccgatcttcggagattccggcaggttttgtttaataaaagcggctgcgcgttcaattctgtccttcaagaaacagtccccctattgtaataaagataaaaagcttttcccgtatttcggtttattcgtttggaaattatcagcgatcgttgcaccgatatcagcaaatgtatctgcaagcggcagcatttgcgctttcttatgttttttgctgtaagcgagaatcggcacatactcgcgtgtatggtcagtcccatgatgaatcggatcattgccgtggtcggctgtaataattaacagatcgtcttctctcattttttcaaacacttccggaagccgcgcatcaaattcttcaagcgcgcgtccgtagccttcagggtcacggcggtgtccgaataacgcgtcaaaatcaacaaggttcgcaaagctcagacccgtaaagtcttctcccagcgtatcgatcaccttgtccattccgtccatattagaaaccgttctgcgtgaagaagtaatgccttctccgtcgtaaatatcagagatttttccgattgaaatcacatctaagccgctgtctttcaattcattcatgacagtgcgatcaaacggcttcagcgcataatcatggcggtttggcgtccgtttgaattgacccggctctccgacgaacggccgtgcaataatgcggccaaccatatatttcggatcaagcgtcagttctctcgccgtttcgcaaatgcgatacagctcctcaagcggcacaacctcttcgtgagcggcaatttgcagaacagagtcagcagacgtgtaaacaattaaagcccctgtctccatgtgctcctggccaagctcatccaaaatcgctgtgccggaagccggcttgtttccaataattttgcggccagatctcttttccagctcttgaagcaattcatcaggaaagccttccgggaacactttaaacggtttatcaatgtataaacccataatctcccaatggccggtcatcgtatctttgccgtttgacgcttcttgcatttttccataataggcaagcggatgttctgttttttctacacctttgatatcttcgataagaccaaggccgagctttgccatattcggcatatgtaatccgttcatatgctcggcaatatgaccgagcgtatgagcgccttcgtcattaaagtcagcggcatccggcgcttcgccgattccgactgagtccatcacaattaaaaacacacgattatatttgtatgcaggcatcttgaaagcctcctttttttctatacgtctattgtatcgctaagaggtctgacaactcaagtataaaccgttttcattcccgttgacaatgtatttggaaataatgagaaacttcaatattttctgtcgctctaaacaaaaaagccgcagccacctgcggctatgctcgcggatgaaactgcttgtacacatccttcagccttgttttcgtcacatgcgtataaatttgcgtcgtggatatatccgcatgcccgagcatttcctgcaccgctcttaaatctgccccgttctcaagcagatgcgtcgcaaaggaatgcctgagcgtatgcggagtcagctctttcttaatgccggcttccaacgcgatttttttcaggttcttccaaaatccctggcggctgatctgtttgccgtgatgatttaaaaagagggcgtcagacacattgttctttaacagttttcccctggcttttgtcatatattcctcaatggcggaagcggcggcttcaccaattggcacaatccgttcttttcttcctttgccaaagcatcggataaaccccatagataaatgaacatctgccgttttcaactcaatcatttcactgactcgtatgcctgtcgcataaagcagctccagcattgctttatcccgatagccgaatgggctcgtcagcttaggcgtgtccaataaccgctcgacttcattgagtgcgagcaccttcggaagcgcccgttccgtcttttgtgtttcgatatgaacggaagggtccttatccgttactttttccctgagcagaaattgatgaaaagagcgaatggatgccaaatgccgcgccgatgtcttaccggatttccccgagtccttcaaatactttaagtattggataatatgtatgcgggtaacgtggttccaatccgtcacatgaagggtttctgttaagtagagagaatagcttttcaagtcacgttcataggatacgatcgtattttgagagagccctctctctaccatgacgtagtggatgaaatcctttatttgatctttcactcttgatctactccccgttttggtaaaaaaagatcaaccggtcgagccatccgcctttttcatcctgatccatttcaacaacttttacagcggagccttccggtttatcataccgatgatagttttcatactcttgattcacccatatcatagcataatagaacaaagcggtaaaaccggtaaacaggatgaaaactttcaatgcatcgacagctgttttcaggaatcttcccatgtcctaatcgatcctttcctatggttccagttatataaaccatatgccaaatcagaaaggttttatacatagaaacagcaaaaaaccctttccccatgagaaaaggttcgcgctcggcaccatctattcagtttcttttccattacagcggtggcaaatgccgtgaaacgtcaatctatgatctttaatcttaaatttccaatcacgttcaatgatttcttccacgtcttcaagcaaatcttcttcaatttcatcaacggctccgcactccatgcacaccaagtggtgatgaaagtgagctgcgccctctttccgaaggtcgtaacgggacacgccgtctccaaagttaattttatctacgacttttaattcagttaataattcaagcgtacggtatactgtagcgagaccgatctcaggagatttctcttttacgaggaggtatacatcttctgcgcttaaatggtcttcttcgttttcaagcagcactcttactgtcgcttcacgctgtggcgtaagtttatagctggatgagtgcagttgtttcttaattcgatcaatacggttttccatgtctttccctcctacgccgcattccatgactcattataacaaaatacgcgcagagttccaactataattattataaactgataaataaaacggttttcttttaataataattttaaaaaagtctagatgtaagcttttccattaaaacaggagataagtatgcttcaaacagagatgagatcagcgctaaaaacagaatgaccagcagcacaaaggcataccgcccgaaccattgaatcggcgcgtcatgcaggcttcgtttcacgaacagctgtctgattaactttaaagaaaacgcaattgcacatgtgcccataatgagataagccggaatcagcagcacattttgcggcaaaacggcgacaaatgataggaaaaacccgcttactcccatctgattgactaggaacccgacagtaaagccgacgacgatccctttcagaaagatcataatgaaaataatcggcatcccaatgacggaaattccgagtatccacatcaggcctaaatactttgcattatgaaagatactttgcccaaacatatcagctgaacttgcctgttttccatccgaaagctgtccaaaaaattgacttaagtagtagtataaatcttctttctggctgatggtcatactgttgacaataatcgcgccaaagatgacacccatgaaaaacagcactgacacaaatatataaagagagagatgatctttgacatgcctgagaaacatgtccttataagagatttttcgcataccgtttcctcccgcccgttctagtgatttgatttaatagattgtatgaaagaaacggaaaaacatgccctttttcaaaaagaaacgatagagatgaatgctaggcggctttttggggcacaaaaaaatccttatcatcaactgctgtatgatcataaggattcttatgcttccgtttattcaaaatctcttttttgctttttgtcattctttcatgtgtgctgaaagatggtgtgctgcctcttgataataagacgtcacgtccgccgtttctcaatcgatgcccccgcttctttttcgcttggctttttgccatgtgatcactcccttttttattttcatagtaatgataacaaaattgaacaatgataagaaaaaaacagcacctgctacgacaggtgctgtttagctacatttatttcactgctgtaagagctgcatgctcgacagctgctgctaccgcatgatggacttttgaatcaagcggctgagggacaacatcaccttgtttagtgcaagctgcgatggcctctgctgctgcgacaagcatatcatgattaatctccgtgctttttgcgttaagcgctcctctaaaaatccccggaaaaccgagtacattattaacagaacgcccgtcagctgcatatgcggcgccagcctgcagcgcggcctccggttcaatttccggcttcggattcgataaagccaaaatcacttgaccagaacgtacaaatgccggttttattaaacccggaacgcccgttgtagcaatgacaatatcacatgtttccatgagctcctcaatactggaaactgcctgtccgccgtattgttcgagacgattcattgctgactctgatttgtctgttccgtacacagcattcacaccataagccatgaacatccggcagatggccacgcctgctgcgccaaggccgatttgccccactttcgcttccttcaggtcaacccccgcactcctgcatgccgaaatggcagctgccagcgtcactacagctgtaccatgctggtcatcgtgcataacagggatgttcagctcctcttttaggcgatcctcgatttcaaaacaatgcggcgaaccgatatcctcaagaaggatgccgctaaagcccggagaaatatgttttactgttttgatgatttcttcaggatcactcgtatcaagcagtatcggaatgccgctaatacccgccagctgatcaaacaaagcagcctttccttccatgacaggcatgccagccacagagccgatattcccaaggcctaaaattgcggttccatccgttacaattgcaacagaattgctgatcgttgtataaatagaagctttttcaggttctttttcgatcagtcggcacacgtccgcaacacctggtgtgtagacacgtcccagctctgccagtgaacggatcggcattttgcttttcatttggatttttccgccttcatgtgcggacaggacttcatcagatacggtgtgaagcctgatcccttctccgagggcctgtacagccgcgatcacttcctgaagctgttcttcattctccacttgaacggtaatattccgcattgtgtaattgggtccgacttttaccgtctccacttcaccaatatccccgcccagaaggccgatggccgtagccacccttccaagatttccgggaaccgaaggcgtttcgatcatcagtgtccgaatcatgtgtttcgctatcattcagtgatcctcccctattagcctagtttttcggctttaactgtattgtttttcgtataccatataaattttcctgtataaccatagataattgcaagacctattgctacaaaactgagccacataaacggcagataagagaaggtagaaacacctaaaataccagccatgtaaatcccattatcagaccaaggaaccatccccgaagtcaatgttcccccgacctctgagttacgtgataacactcttctgtccagatgtaagcgatcatagctgtcttccataattttcggagtcaaaataagagatacatacatcgcacagccgaagatgtttgctaaaaacgctacgatcagtgtagacaatgtgacattgccggctgaagttaatttcttttcaaacgttgaaacaatgacttttaacacgccgagtttctcaagcagaccgccaaaaccaaggccaaagatgatgacgacgagagaatcaagcataccgacaattccaccgcggtttaacaagccgttcaaaaattcaacatccgttttaatagagaagccgttgtacgcagttgcaatcgcatgggcaatatccattccttggaaaacaacagcccagattgcaccgagtaaagcgccaattacgataaccggcatagatggctttttcatcgccaataagactatgacgagaactgccgggatcagcatccaaatatgaatgtcaaacgtgttttgcaaagatgattttaagaattcaactttatcaagatcaatatttttcccgccgtacataaatccaacaactgtaaagagtatagctgtaatgacataagcaggtattgataaataaagcattgctctcacgtgagccaatacatcgacttttgatagtgaagaagctagaactgtactgtcagacagcggagacagcttgtccccaaaataagcacctgaaagaatagctcccgctactagaggaagcggaatgcctaacccctctccaattgcgatcatggcaatgccggcagttccgactgttccccatgacgttcctgttgccacagacataatggaacaaataattaacgttgccagtaaaaagatacttgggtgaataaattccagtccgtaataaatcaaagtcggcacaacgcctccggcaatccatgttccgatgagcgccccaactgaaacgagaatcagtacggcttcaaggccatttgatatcccatgtacaatcgcattttgtaaatctttataagaataaccgagtctaatacctaaaagcattgcaataaaccatgaaacaaaaagcgccagctgtatcggcaagtcgagaaagactgtaaacgatagaacaagtgctaaaaatactcctagtacaataataatttcaaatagtgttggcaatcttacatccttcaaaagaagtcccccttcatgtaaaagctaaaacgctttcaatatatagtgcaacacgtatactatacttcctcatccctatgttgtaaacagcttattcatccgactattcggagatgaataagctgtattttatacaaattttatttttctaatagttctttccctgcgatacctggtttggtcatctcatatgggtttaaaataatatccaattcttcttctgtcagcacatcatgctgcaggcaaaggtcacggactgattggcctgtcataatcgcttccctggcaattctggcagccgcttcatatccaagatgcggattgacagctgtgatcacgcctgcgcttttttctacgtattgcttcaaccgcttttcgttggcttcaatgccttttaagcagttgtcagtgaacgaacggaagccgttgttcatgatgctgatggattgaagcaaattaaagacaagcacgggctccatgacgttcaactcaagctggccggcttctgaagcaaggcagattgtattgtcgtttccgataacctggaacgcaatttggttgatcagctccgccataactggattgactttccccggcataatagatgaacccggctgacgtgcaggcagagaaatttccgcaagtccggcgcgcggtcccgacgccattaagcgcaggtcgtttgcgatcttcgacatgttcatcatgcagacttttaatgaagctgatacctctgtataggcatctgtattttgtgttgcatcaacaagatggtcagcgccgacaagaggaagcccgctaatatcagcaaggtgctttactacctgtttgatatattcaggatcagcgttcagccctgtaccaacagcagttgcgcccatgttgacttcatacaggtgctggcgcgattgcttgattcgtttgatatcacgctcgagaacacggctgtaagcttcgaattcctggccaagacggatcggaaccgcatcttgaaggtgtgtccggcccattttaataacagagtcaaactcctgtgctttttgcttaaacacactatgcatatcttccattgttttcagcagtttttccaagagcttcaatgtggaaatatgaatagcagtcgggaacacatcgttcgtagactgtgacatgttcacatgtgtgtttggacttaaatggatataatctccctttttatggcccatgatttcaagcgcccggtttccgataacctcattcgcgttcatgttcatagaagttccggcaccgccctgaatcggatcgacgataaactgatcgtgccacttgccttccagaatctcgtcagcggcttgtacgatagcttggccaattccttcatacagccgtttcacgtccatgttggcaagagccgcagcttttttcacaatcgccagtgcgttaatcatttcctcatggattttgtatcctgtgatcgggaaattttcagaagcacggagcgtctgaattccgtaataaacatctgcctcaatttgtttttctccaaggaagtctttttccacgcgatattctttttggccgtttaacataatctttaaccttctttctctttgctggttatcgtttttacattttacaggacaacgtcatcagcaatcggtgtttccataattctcttgacgacaggaagatccgaagactgacctagtgcccacatcaattttggcacaattgcttctgtgttcatatttcttgatcggataattaagtcttggttgaccctgcggccaacttcgtaaatgctcatgtcttcgccttcttcaagacattgagtcgtaatgacgacgacaatgccgctttcgatcagttcattcacttttgacaaaatgtctctgccttcaaacggcacccctccgctgccataactctcaatgacaatccctttgtacatgcttttcagggcatcaaacatttcaggctttaagcctggatgcagcttcagcagacatacatctgtgcatagtgaagtgtcaactgtgaaggtgtcgttctcaggttccgttacttgtttgttgtattcgatcccgtcttcattgataaaagcgatatatgggtaattgatgctttcaaatgcgtcgtagcttttcgttcttaatttgatcgcacgcgttccctgaatgactctgccgtcaaacacaacataaacgccgcccacgccttcacaggcaaatcgaatggcatctgtaatattttttttggcatcggttttttggaacgtgatcggaatctgcgagccggtgatgacaatcggctttttggcatgctgcagcatatacgatagtgcggcagatgtataggccattgtatctgtaccgtgagtaataacaaacccgtcataggcatcataattttccttaacggcttctgctatttccacccagtattcaggctgcatattggtgctgtctatattcataagcgactgagtttccattgtgtaatcgttatcaagttttgatacgtaacttaataattcatcagccttgactccgggagccagcccattttccccttcaactgaagcaatcgttcccccagttgtcaacatcaataattttttcataccatgcacctcttcactgtatctaaagatgggttgcgagaaggtattcgcttttcgcatacttttaatgcaattatagacacggaaaataaaatacgcaagacattattattcaattcgcgtacacttcctaatacctatatgatataatcagctcaaggtgaaaaaggagcggaagttcatgaatctagatcgtttaactgaattgagaaaaaagaaaaattggtcgcttcaatatacagctgaccttctcggtatcgcaaaaagcacatatgccggctacgagtcaggctaccgacggccttcacttgaagcgcttgccatgctggctgacctctttgacacaacctgcgatgaacttttaggccgcgagaaacaaaagcagactgctcctcaggccatagaattggccacgtggagcagccttgactttaccatttctgttgatggccagccgctgagtgaagatgaaatcatccagctgattacctttatacgcacaaaaagaaaagtacaggaggaactgagttaatctttagctcacggtttaattttaccgtaggttcctcctcctccggctttcaattccagttttccggatctcgcttttacgataagcgccgcagttttcggcgggacaatgcgagccaaatcttcttctgcagcctcatgaagaacagccatttctgttccgaaggctttttttagtttgtccagcgttttcgggcctacacccggaacaaattgcagcgggatctgatgtacatatcgcggacgcgggacgcgaacttcaagctgatcactcaattcacgcaatctttcgctgactcccttggtaaatctggcatttccgcaattcgcgcacgctgtttccccgcttacagcaggctctccgcacgcttcgcaagcggtctgataatatttccccaataacgggtccaagccataatttgcgataattttcctgtcatcttgtccctttaatgcaagagcaaattcagtaaaatcagctgactgcacatatagttcattatattctctgccgattttccccaacgaatgcgcatcagaatttgttaaaaaaggatacggattcaattcagatacctgtgatgccatgtctgtatcacagcttaatccaagctccaccgcgtctatcatagatggatcaaaaacctcagttaagcttgatttaaccccttttccatataagcttttatgcggcgtaaagatatgggcggggataaacaagccgcccatatcctgcacttttttttgcaggtttaagcccgtttcataaatccgctgcgagcttaaatgaatatttttcagccgggctgacagccagtttgaaaactgtttcatatcagccagcgtcggcataaatacgagcacatggatcggtccgctacaggcttcatcataaatctccagctcgctccccaataaaagagtcgtgctgcgataacggattcctcccccgtcaagctcgcgatattttccagatgaaatgccttcctcaagctctagaatgacttccggagaatgacagtcgataatgccgaggagttcaattcctttatgttcactggcttcaaccaaaattctgtccagtgttaatgttttagcgcctgttattttgacagcccttcctgtaaaggtccggccgatatgaatgtgcaaatccgcgtaaatctttttcatttttgtgcttggagcgcttctttcagctgaagatactgaatcgcgtaggctgttttagcatcgtatacttcacgcgattcaaccagctttagcgcatcttcaagcgtcacctccatcacttcaacaaactcgtcctcatcaagctcccgtttttcttcaagcacagaaagctcctcagcaagaaaaacgtgaacgatttcatctgcaaatccgggtgatgtataaaacgcagttatttttgtcagtttttttgctgtataaccggtttcctcttcaagttcccgaagtgccgtatactccggctcctcacctttttcaagcttaccggccggaatttcaacgatcgtccgctcaagcggcttacggaattgtttgaccaggatgattttcccttcatctgtgacggctagtaccgctactgctccagggtgtttcacaatttcacgtttactggctttgccgtttggcagctctacatcctcgacataaagatcaatgactttacccgaaaagatctgttctttggcaattgttttttcttctaatgatttcatttcttcatctcccgttctgtctctatatgatgccccatacattttatcatactagagcaaaagggggcttcttcgtgaaagtgcaccgcatgccaaaaggtgttgtcttagtcggaaaagcatgggaaattcgggcgaagttaaaagagtatggacgcacatttcaatatgttaaagattggatctcaaagccataaaagttgaaactttagctcctttatattacggtcaatacaaagcctaaaaaaggagtgtgcacatgagaaagcgcaaattgggtacatctgatttagacattagtgaagtcggactcggctgtatgtctcttggaactgaaaaaaacaaagcattgtccattctggatgaagcgatcgagctcggcatcaactatttggacacagcggatttgtatgaccggggacgcaacgaagaaatggtcggtgatgcgatccaaaacagacgccaggatattattctggcaacaaaagcgggaaaccgttgggatgacggaagcgagggctggtattgggacccttcaaaagcttacataaaagaggcggtaaaaaagagccttacacgtctgaaaacagattatatcgacctttatcagcttcacggcggcacgatagaggacaacattgatgaaacgatcgaagcgtttgaggaattaaaacaagaaggtgtcatccgctactacggcatttcttccatccgcccgaatgtgattaaagaatatgtaaaaaaatcaaacatcgtcagcattatgatgcaattcagcctgtttgacagacgccctgaggaatggctcccgcttttagaggaacatcaaatcagcgtagtcgccagaggtcctgttgccaaagggctcttaactgaaaaaccgcttgatcaagcttcagacagtatgaaacaaaacgggtacttgtcctattcattcgaggaactgacaaatgcccgcaaggcaatggaggaagtggctcccgatctttccatgacagaaaagtcgctgcagtatctgctagcacagccggctgtcgcttcagtgattacaggcgccagtaagattgagcagttacgggaaaatattcaggcagcaaatgcacggcgtttaaccgaggaggaaatcaaagcgctccaatctcatacgaaacaagacatttacaaagctcatcgctcatagcagaaaaaccagcacccgtacaggtgctggtttatttatattgatgccaatccatttggctttcatttaggagttcttcaaagctcttatttttttcgatctcttttttctttctgatctgttctgctttttctctttcctgcctcttttcatcctcttccttcaattggctcttcatctccataagctttgctttgatatcggattgaaggccgtcttttagctggtgtttgtcagcaagatttttgttttttcattcagacttcccccatgttttgttttgaagacagtttatcacggagcatatacactgaacaagccgactctcttctgatcactttctcagcggagcagtgtttaggtataatgatttcaaacacgaattgcctatatatttagttgaaaggtgctgtgacttttgaagaaaatccttttggccattggcgctctcgtaacagctgtcatcgcaatcggaattgttttttcaaatatgattctattcatcaagaaaaaaacggatgaagacattatcaaaagagagacagacaacggacatgatgtgtttgaatcatttgagcaaatggagaaaaccgcttttgtgataccctccgcttacgggtacgacataaaaggataccatgtcgcaccgcatgacacaccaaataccatcatcatctgccacggggtgacgatgaatgtactgaattctcttaagtatatgcatttatttcttggtctcggctggaatgtgctcatttatgaccatcgccggcatggccaaagcggcggaaagacgaccagctacgggttttacgaaaaggatgatctcaataaggttgtcagctggctcaaaaacaaaacaaatcatcgcggattgatcggaattcatggtgagtcgatgggggctgtgaccgccctgctttatgctggtgcacactgcagcgatggcgctgatttttatattgccgattgtccgttcacatgttttgatgaacagcttgcctaccggctgagagcggaatacaggctcccgtcttggcccctgcttcctatcgccgacttctttttgaagctgaggggaggctatcgcgcacgtgaagtatctccgcttgctgtcattgataaaattgaaaagccggtcctctttattcacagtaaggatgatgactacattcctgtttcttcaaccgagcggctttatgaaaagaaacgcgggccgaaagcgctgtacattgccgagaacggtgaacacgccatgtcatataccaaaaatcgggatacgtaccgaaaaacagtgcaggagtttttagacaacatgaatgattcaacagaataaaaaagcgaaaggcctattcggctcttccgcttttttatgttacagaacgtcggtaatgccatccatattttctctgatccattcaatcgcaagatctatcgttgtaaactcctgcgtctcaaaggtcatttcatcctgcaatagccagacatctttcttgatggactctgctcctccgattgaccagtgaagcaaggtatagggatggttttgattcaggaaggatacccacgttttattttgtgctgtgttcttcattgccttcagcttttgttccacgtttcgcgtctcctactttactaatatgctcattctggggctgagcatttcagccgggcttttcagcgccaatgttttggctttttcattgtaatcgatcgtcatttgatcgtcaaaaaacactttttgtgacgattggatatacagcggaatgccgttcgtttccagctgctcgcactgtcccgttaattcttctgccagccagattgtggggacaccgcttaccgcgcagccgcatccttctgcatcgtaacgaagctgggctttttttcccgggttggcgtcaaacgcctgctgcagtgcctgttttgctgcatctgtcacatgtatgttcataaggtgaaacccccgttttcatcattttcgctattgtagcatacaacactgccattcgcattgtttctgccttttttccaccgcttcgcattttcttctgcagtcttgatccactcatctttcccttttatgtactgattgatgctgtcaggatgctgggccgccagccgttttttgagaacggcgtattctttcgctatgtttggatgagctctgagataatctctgaataacagatgcctttcaatagcagggtttccctgttcgtacatatggacatgatgagtgcgtttatttccgcccttttggaaataacgcctgcccgctatgccgttctcaccttttggtgtatagccgttagccttcatttgttcatcaaattggctcacggcttcaatgcttctgacttcaattaacatatcaatgattggcttcgctgccatgttcggtatcgatgtgcttccgatgtgatgaacagcgataatctccggcccgaacacaagtttcagcagttctttttcttcatcgaaacattctgcccatttttcgttgtagagaatgacctcaacttttcttttcggatacaaatgaaagaccgacagcaatagaccctgcgctgctttgacggtttctgccttttggaatccggcctgtgtatagagtgacacggccggggtattgttctcggctgtgactacttcgattttctcagcgtcttcattatgatcaatgacaaattgcagaagtgctcgtccaattccttttctgaaaccgtcaggatgcacaacaagcctgcaaatggtgagatgatgcatgtttttctcatatgaaatgacaccgatcagcttgccgtttttccgatatcccgcaaaccgttcatgggatgcttgaatatccttcaccttctcttgtaaagcgggaataccgtcaaaaccgataatctctgtttcctttatgtaggcggggatctgtacggctaaaatctcacgcgctatcgtgtcttccttatgctggagaaattcaatcattcgtgttcctcctgaaacagccgctgtctttcgacttttgcgacgcggactgcatacgactcgtaccaaaggctttttcctttttcttttgccgcttgatgttcagtgtgatgcttccaatggttaattgcgtccatactgtcccaataggaaactgtgatgccccttccatccgcttcacgtacgctttccacgcctaaaaatccaggctgatccgccgcaagtgataccatccgctccgctgtttctccatatcctgtgtcattttcgcttttgacagaagaaaaaatgactgcatagtaaggaggctcaggtgtttttgataaaaaatccatcatatttccccctcatatgtttttgacaaacagtaccctgtcttgacccggaccatcatagtttgcaaacactgagatgccatttaccgtcttggtgcccttttcaatatcaaaccccaattttgtgtgatatgcgattgataccttattcacaggtgaggtgacgcactttacccgggtgcagcctctttgttttactgtttcgataaatacatcatacaattgtttacctatttgcatttttctgaaatctggatgcacaccggaaaaatgaatgtacgccgtttcaggatccgattgcgattgaaatccgattaaaaatcccgtcatgctgttatgttcggatgtaataaagcttgtgtcctgaaaatgctcaaaaaatagtctcggcaatttttctttcagctgtctgccgccccaccattcattcagtacagacgttaccatttcataatctgaagacgtgattgttcgaatatccattacgatttgatctccctccgtctggcaaaacgaatgtcagctctttttctcacaatataaaaattatattttgcctggctggaattgtaaatgccttctttcctgtatcatacgtttccagactgccgagggaacaatgtttgatcattttacgcctatttctcccccaaacaggaggagagactttacagcacaatatcaagcacttgatcaagtttcagcttataaagctgatcctcgtctccttttatccatactgctttttcaaactcttcataccggcagattttcccggtgcagcagacaatctcaccgtcctgaaagcagctgacagtgatatcctgagcaaactccatcgcggtgcaaagcgtttgattcatctcttccagcttatcggggtcaaggatcggcttttgcagcttctgtttaagtcgctttctctccagcaggctttgcttatgttccggcagaaacatcctgctcccttcccacagcaggttgcccctttttaaatgatcgttcatttataatgcccccctattttagccgcacgttcaaatgcctggcctgccgctgtcagtgacgccgccctgatgattgctgtgtcgccgaatcgatttttaatgccgtccatcacatagcctaggctcattttctttgcataatcctgaaataaattgagctgccatatgtcatcagatgagagctgagacagattgacaccgagacggcggacaggtttcccgtcccaaaatgtaagaaacagccggcgtacagcctcatatacatcctgcgtagaattagtcggctctgccagcttcacttgccggttgaagcccgtcggccaatcaaaatcagcaccccggcagctcactgacaccgtctgccccatgaccccggcgtttcggcttcgcctgcacacttcttcactcagctcaagcaatacgaccttgatttctttgtcaaagtgttcgtagtctctcgggagagtcattccatggcctatcgccttttgcccgtccagagacgaagttgacacaggggaatagtcgattccgtttgccgtcatccacagcacgtggccgttaatgccccatttcttttttaaaagatcgagcggaaaagccgcgagcccgccgatcgtgctgatgcccattcgatttaaatgatgcttcatgcggctcccgacgccaaacatgctgcccaccgggagcggccacatttcggttttcatattttctttcgttaaggtaaaaataccgttcgtattctttttggcaaaattgtcacacgcaattttggccagcgctttgttagggccgattccgacccgtgcataaacgccgatctcccgcatgattctgccctgaatgcttttcgcgatctccatcggcgtcccaaacagcttctggctgcctgtaatgtccatgaactgttcatcgatagaataaggctccacaaggtctgtatactcctcgagaatggccgtaatttgcagtgatacatcaatataccgctgcatacgcggccggagcacaacagcctcaggacacttttcctgcgcctcccacagccgtgaagcattcaccacacccttttgtttcgccagcgggcaggcagccaatacgactccgccccttttttcagggtcacccgaaacaatgacgggcttatttttcaaatatggattttccgctttctctacagatgcataaaacgattgcatgtcaacgagaaaaatcactttttctttcatcatacacacctctaaaaagaacttatgttcgtttttcattatatgcgaaagtatgttcgttttatactggtaaatgattcttgtctgacagaaaatatgatccaagggtttgagagaagaaaaacatttagtagaataaaagcgaacataaggataggagagtcatgatggagaaatttgtcgaaaaaatgatggaacaggcattgcgtcaatacggcagaaacgttgctatagatccgttaagcccgtatgaaaaacaaagcctgaaagcggctctacaagagagacggaatgaagaaccagatgaggatttgcatgcgcatatagaagatatcatttatgactatgtcacaaaccaaggtctgttctcttaaacgcatgactgtcagttctttcagccgctgatgcggcttccctttgaaaacaccgcctgaaacaaataaacagtctcaggcttacagaaaaaagcaggattttctcacgctccatagattcatatggcctggcgtaaaattccccctcagaactcgcgcaaaacggaataagctgtccatgatcacgcgtatacactttttcgaagagatgtgctctcttgttctgtcatgcggtccatcggttttcagcttacatcttgatctcatagccggtttcactgccgatatgatctacgtcctggcggcttaaactaacacaccctcactgaccaatcgctttgcttttcatcggacatcccgtcatttttcttcttcaatttcaagatgtaaactccgtcagccacacgcatcctcaacgcatagtatattgccatccatacaatcaggcatactacatgtcaaaaacgaaatattttgaatgatctattggagaaggaaattttttcatatatgatagaggaagatcttacatacaggagagaatataattcatgaagaaatggaaagatatccacccgatcagctggacaattataatcggaaccattttcggcagaatggcaacatcgatgagcattccttttttagcgatttatttgacagccgtccaaggcgcatcagcttcctatgcagggctggtcatcgccgcgagctcatcagtcggcatcctcgcaagcttttacggcggatatatctcagataaattcggcagaaaaaacatgatgcttgtatcgattttcggatggatgctggtatttgcaggctttgcggcggcatctcatctctgggtgttttttgtagttaacgcattaaacggtctttgcaaatcactgtttgagcccgcttcaaaggccttgctgtctgatatgacagaagaaaaaacgagactgctagtttttaatttacgctatgcagctattaatatcggcgttgtcttcggacctgtgcttggcctatatttcggctcatcgcaatcgactacgccctttttggtgcctgcagtcatttacggactatacggaattgtgcttgccctccaatttaaaaaacatccatccttatcagcaccagcccagtcccgaaatatgagcgtgcgggaagcgtttatggtcacgcaaaaggattatctttttaccattgctttggtcggcattacgctatgcaccttcggctactcacaattcagttccacattccctcagtatatggcgcagaaccccttgatcggcaatggaacgaagctgtatgggctgatgctgacattaaacgcaatcgttgtgttggcgacgcaatttcccattgtccattttgcaaaacggttttcgccgctttgttctctgatgctcggtaatgtgatggttagcatcagcatggccattttcaccgtatcgcacggtgttccatcaattgtgatgattgtcatcacatttacaatcggcgaagtgcttttattctctatgatggatttgtatgtagaccagattgcaaaaacagggttaaaaggcacttatttcggggcaatcggtttttcacagctcggaaacgtcatcggcccttgggtcggggggatatgtatagacctgtttggcgctggccgtccgatttatattttttctgtcctgagcggcattaccctgctcggcctgccatttttagcgttcgcctatcggcagatgaaaacggagactacaaaacaccgttcccgtctggaaaagccgctttaaataaaaaaacgggagagaatcaatctctcccgcaacaatgaggtgatgaacatgaatataggcgatatgatgtttcagctgtttgtatttattatatttgccgctgttatctttgcggctgttacaggcttcaagtatgcgaaaaaccgaaaagcgcagctggatcgcattgagaaaaagctgaacagcctgtccgaagatcacgattaacagcttggggcaacgagctctaccttaatccgatccggatcctcacaatagactgcataatgcccgtctcctccggcaaaaggatgcctgtctcggtacaacacacgatagccttttgccgtcaatttttcggtcatctgatcgacttgatgcttggattcagcataaaatgcgagatggttcagaccgactcggcatctatggtattccggctctagaaatggctctttcgcctgcacaatcactaggtaaaaacgatctttcttccagctgatgcctgagctccatttttgatactctttatagccaagttcttttaagaaccagccccaaaaccgcctagacgcctccaaatcagagacatacagttcgatatgatgcacaatttcataccctccttaccagcacttcctcgaccttatgcccgtctcccttacgcaaaatgagatctgacctgaatttagtcggcaaaatattttcatataaattcggccggttgacactctcccaaatcgaggctgccatctcgtcagcctcctgatcggacaagtctttaaatttatgaaaatatgaatcaggattttgaaaagcagtttcccgaagcaggcgaaaacgctctaaataccaagtgaaaatccggctttcctccgcatccacataaatcgaaaaatcaaagaaatcggaaacaaaaatacgcgggttttcccggtcatcctccaaggtgggcgactgaagcacattaatgccttcaataatcacaatatccgcctgttctacaacctcgaacacaccttcctcgcggtcataggttagatgggaatacaccggggcctttacgctgtcctttcctgattttaagtcattcaaaaattcgagcagcgcctttacatcatagctttcaggaaacccttttctagacatcatatttttctttttcagctcggcagtaggaaataaaaaaccatctgtcgtgataaggctcacttttggacggtcaggcaaacgcgaaagcagcttctgcaagatccgcgccgtcgtgctttttccgactgcgacactgccggcaatgccgataataaacggaattttggctgaatgtggatgcttcaaaaaaacattgacatgcttattgcgttcagccgcagacttgacatgtaaatgaagcaagcgaacaagcggaatatagatcgtttccacttcttcaacagatagataatcattcaatccttccacagcttttgcctcttcttcagatacagcaatcgacaaatgccccccaaaaccagaccaagactcccgattgtgctgtgtatataaagtatgtaggttaagttctttatttttcactgtttacacctgactctctgtaggttaaaacccttacaaagattgtaacggaaaaccttttcactgtctgcttatttttcatttcgtttttttagcaaatcagcaccaattcggttatacgcagccatttcatcttttggaaccatgcttcctcccgttccccagacgacatgtacagcatgttccatcttatatttttgaccatagcgccttccctcttctgtcgaaaaaagctgaaccggcccgaacatgcccgcaagagcagagggctctaaatatttatcttcagatacagccagcatatgaagcaaagtataaagcgtattgtcctctaccgtataacagccgctcagaagcggttcaatcagcttgccgacaaatcctgacggcctccctacggcaagtccgtcagcagcagtctgattatccaggccgatatcctggacggagatcttttcgtgaagtcctgaataaagccctaacagcatacaaggtgaatgagttggttctgcgaaaaacacatgaacatcatctccgtataaaagcttcagcccaaatgctacaccgcccggtcctccgccgactccgcacggcagatacacaaacaagggcgtctcaagacttggctttatattcatacagtcaagctgcgtttttaatcggcttgcagcaacagcatatcctaagaacagctgtcgagaatgttcatcatcaataaaataacagaatggatcatgttccgcctgccgtctcccttcgttcaccgcttcgctgtaatctgtttcgtactccataacagtgactcccttttgacggaggagatcctttttccactgcttagcatcggcggacatatgcactgtcacgcgaaagccgagtgccgcgccgatgatgccgatgcttaaacctagatttcctgtcgaaccgacagcaatcgaatagcgggagaaaaacccggtaaaccgctcttcctgtaagatgcggtaatcatcggtttcctgaagcattccttcttgaagcgcgagattttcagcatgctttaacacttcataaatcccgcccctcgctttaatcgatcctgaaatcggaagctcatggtcgcactttaaaagccatcttccgggaaatggctgctgatatgccgcttccagctttcccttcatatgctgcacctcaaaaagcggagactcgatgattcctttagcgcctttcgtctcaggaaacacctcggcaatgtaaggtgcaaaccgctgcattcttttttccgcttccgctatctcggttgcccactcatctgcacggggtaatggcccctctttcttgcctgaatttgcccagaatacaggctctgcatcaatcagtttctgaataaacggatctttaagcagagcatgaaggacttctgaatgaactgacattcaacaatctctcccttccactatcaaaaactgccccgtgagaaacaagccactccaccacaggcagttctatcattattttttcatgagcgcgcgtcctgccagcttttctacaagagctggaaacagctgatacagcttagtgccggcattcattaaacgcggaagattgatctcccgctttttcgtaaaaattgcagctgtaatttgagctgccacgtcatcaggatcaagcatccagcggccgacatttttggcgtagtccccgcctttatcagcaatggaaaaaaagtccgtctgaatcgggcccgggttgactgttgtcacataaatgccggttcccgaaagctccatccgcaaagcgtttgagtaacctaacacggcatgtttggtcgcggaatacaggctagacttcggtgttgcgattttccccgcttgagaggcgatattgatgatatgtccctttttttgctcaagcatctgcggaagcaccgcttttgtacaggcgatcaggccgaagacattcacatcaaacatcgctttcatgtcatccaatgtagagtctaaaaccgtttcaaatataccgaagcctgcattgttaatcagtacatcaaccgagccgatctgatcgcggacccgggcgatatcctctaggcggccgacatccagaggaaaaatctcacactgtccgctccattcctcggttattttccttttgatttctatcaaacgatcctcgcgtctagccgacagaaggacatgggctccttcagccgcgcataagtatgcgattctttcaccaagccctcctgaagcgccggttatccaaatcctttttcccgctatatgtttcacccatttcacctcttcattgttttaaagtatgcggtatttccttcccaatatgacgtgatggcttcttcagcctccaacacatcaaggtgacctgccgtttctgacatcgttaaaaacaattccttttcatatacagcaggaaaaagctgctgacagacctgaaaagcggtcatcggcttttcatccagcatgcgacgcacatcctccgtcctgttcctctgcttgtcaaaacgcttctcaatcagcgcttgtacactggtgataggctcgccgtgaccaggaaatacgattgttggatcaagttgagacagccttcgcaatgaccgctgataatccactaaaggctttgacctgacgtcccccgctttcggcgcttccaaaatcggattagacgagctgtttgccagcagtagatcgccgccaagcatccttccgcttttttcatggaacagaacgatatgcgattcagcatgtccaggcatctccaacacggaccagccctcaagcccatctatgcccataccttctctgattgtttttgtcagagatctcgtacaggaaaatgcgtacgctgatcgaatcagcttttccgccttccccgtatcaaatggaacgcctaattcaggcagcagcttttgaaaaaaacgtttttgccaatccataaaggcttgatctcggctgatataaggttcgttgaatgtatgcccaatcacttcgatttcatctgaaaagacatcaagcaagcctgcatgatcagcatgatggtgagtcagtacaacctgctcgatatctgacattttcacatttacagcggcaagctgctcttgtagggctctggcagcctcttttgtattcggcccggcatcgataagtgtcagtgcatcaccttttacgaggtaaacgataacatcgccgacagcaaacggcgtcgggacgcggatcgcaattacatcttcagttgtcatcctttcgctccttgtcttcattcattattcatattttagctttttctcggtcttgtgtcattattgcagaatgagaacaaacctttttgaaaaagctattgacattagcttatccgccattgcataatgaacaacaaactaaaacgagaaccattggaacgctatgacgaggaatagtatacaaggcaatggcctaagagagcgatacccccggctgaaaggtgttgcggcccgcttgtttgtagaacctgccctcaagtcgcggttaggaaaacctaaacgtttcccgcgttacgggatttgagctgagcacaatttgtgctaatgagggtggtaccgcgaaccttttcgtcctttacgtgatgaaaaggttttttgttgttctgatagaaggaggatatcaatgaaaaagataggatttgtcggcgccgggtcaatggcagaagcaatgatcaacggcattttgcaaagcggcatcacaaaaccagaacatatctatattacaaatcgctcaaatgacgagcgtctgattgaattaaaggaaacgtacggcgtgcgtccatgcagagataaaaatgagtttttcactcacaccgatatcattatcctcgctttcaaaccgaaagacgcggcggaaagcatcgacagcatccggccgtatatcaaggaccagcttgtcatttcagtacttgcaggccttaccatcgaaaccattcagcattattttggcagaaagctcgcggtcattcgcgtcatgcctaatacatcagcggcaatcagaaaatcagcaaccggattttccgtaagcgctgaagcaagccagaatgatattagtgccgcaaaagctctattgaaaacaatcggtgatgcaacactggttgaggagcgagatcttgacgctgtcactgcaatcgcaggcagcggcccggcctatgtgtatcgttatattgaggcgatggaaaaagcggcacaaaaagtaggattagataaagaaacggcaaaagcactcattttgcagacaatggcaggggcaacagatatgctccttcaaagcggcaaacagccggaaaagctgcgtaaagaaatcaccagtcctgggggcactacagaggcaggtcttcgcgctttacaggactcccgctttgaagaagcaattattcactgtattgaagaaacagctaaacggagcgcagaaatcaaagaacagtttgccgttgccgccttagagagacattcttagatgtaagacaaaaacagaaggcactgtgccttctgttttttatttttcccgcagcagctggccggcagattctgattgctttaatagcgcggagatcgtaaatgaaagcaaatcgggaagcacttcaaaggaataaggcatatacaatctttccgtccatttatgcgggtctttaccagccggaccgacatttaaaaccggaacatataaagcctgatttttaccgcttggcaatgaatatcctctgttaaagagcggcatattgcttgtgtatgcatcaacctcctgtttttccagctgaagataactcaagtccgaaagtccggggaagtactgaacctcccgtaatgcaatgccgtatcgctcagccgcataatgctttatctgatctgctgtatttctgatcaattgatcatcctttgaagaaacagctggataaagcggcggactataaaacagaacgatgagcggcgcatcctccttacaaagcgaagcaagctcagaaacaattttcgtcgaaaaatccctgtctccaagctcccccctgttagcaaaggcataatttagagcccgctctgtttccgagatccccgcacgcttttttgcacgcgagaccagctcatcaaatgtcaaaacagtgacgtcccgctcaatcggctgaaatggctcaaattgttgaaaatcctgtgttttcttccgaacgttcgacatgatttcctccgccgcctgttctgctgttttaagcagcatctgatgcagctcactagctgagcgtttcattgacagcacattaaataatgtgacggctgtatgcggtgtctggactgaatatgcctctttcaagtccttttgcattaagtttaccggcggcggagtgacctcgccatcaaccttttcgcaataatcagcattcagttcaagcaaacggttaatctcagataccattaaatttgcgtttaggcctgaaaacggctctccaacatgtgtctcaatccccttgcagaaaaaacccgcaagcaccttgccaatgcttcctgtataaaaatattgctgctggtcgccgggaaatttttcaaacatcggttcggcattcaggcaagcggttaatgtgatatcatgctttttctccatctccttcaatgcaggaaccgcttcaatcatgcctcttgaattcacttcctcgtccggaaccgttatcaacagcagattgccctcaaaatgcccgttcattgccctctccagcatcgacagttgaatacaaagccccgctttcatatccatcgtccctcttccgaacagccagtctccgctttcggcatctcttctcacacgttccgggagcagctcttttttctctaaaaaggagctcaaaagctcagcaggcttgcaagccatatgtttaaattcgccgtaatcttctatgtcaacgacatcaaaatgactcagcagaagcactgtctttttgacattcttctttttgactagagccgtaagaaaagatctgccatcgtccatcggatgaagtgttacatcatcagggtgcttttgaaaatagggcttgtccttcaaaataaaataaagatactctgcaagcgctgcctcgccctttgaaccggtgatgctttcgtattgcacaagagaagttaaaagtgccagcaattcgtccttcgtctgccaattcattgattccgcccctcctatgaataaaaatgcttctatactgaaaaataaactgatttctcgtctattatacagaaatgtttgacaaaagcggttcatttgagcagtttatatgacgggaaagaaatgacttgatataatcaatctctaaaaaccttacgggaggcgaaagaaatggccagaaaattatttacacctattacaattaaagatatgacgttaaaaaaccgcattgtcatgtcgccaatgtgcatgtattcttctcatgaaaaggacggaaaattaacaccgttccacatggcacattacatatcgcgcgcaatcggccaggtcggactgattattgtagaggcgtcagcggttaaccctcaaggacgaatcactgaccaagacttaggcatttggagcgacgagcatattgaaggctttgcaaaactgactgagcaggtcaaagaacaaggttcaaaaatcggcattcagcttgcccatgccggacgtaaagctgagcttgaaggagatatcttcgctccatcggcgattgcgtttgacgaacaatcagcaacacctgtagaaatgtcagcagaaaaagtaaaagaaacagttcaggagttcaagcaagcggctgcccgcgcaaaagaagccggctttgatgtgattgaaattcatgcggcgcacggatatttaattcatgaatttttgtctccgctttccaaccatcgcacagatgaatacggcggctcacctgaaaaccgctatcgtttcttgagagagatcattgatgaagtcaaacaagtatgggacggtcctttatttgtccgtgtatctgcttctgactacactgacaaaggcttagacattgccgatcacatcggttttgcaaaatggatgaaggagcagggagttgacttaattgactgcagctcaggcgcccttgttcacgcagacattaacgtattccctggctatcaggtcagcttcgctgagaaaatccgtgaacaggcggacatggctactggtgccgtcggcatgattacagacggttcaatggctgaagaaattctgcaaaacggacgtgccgacctcatctttatcggcagagagcttttgcgggatccattctttgcaagaactgctgcgaaacagctcaatacagagattccggcccctgttcaatacgaaagaggctggtaatgccataagagatatcctgtagaggatatctctttttttatttttagagaaacgatcggctaaggttctccgtctccctagtagaaccaattagaggagatgactccaatgaaatcagcttggatggaaaagacatatacaattgacggatgtgcgtttcatacacagcaccggaaaggatcaagcggtgtaacgattgtctttgaggccggctatggtacttcttctgagacgtggaaaccattaatggcggacattgatgatgaatttggcattttcacatatgatcgggcaggcataggaaaaagcgggcaaagcagagctaaacgaacagctgatcaacaagtgaaagaattggagagtttgcttaaagcagctgatgtaaaacctccttatttggctgtttcacactcatacggagctgtcatcaccggtttatgggcctgcaaaaacaagtatgatattatcggcatggtccttcttgacccagctttaggcgattgcgctagctttacctttatacccgaagaaatgcacagatcacatacgagaaagatgatgcttgagggcacacatgcagagttttcaaaaagtctgcaggagctcaaaaagcggcaagtccacttaggaaacatgcctcttcttgtgttgtcatcaggagaacggactgagaaattcgctgctgaacaggagtggcaaaacttgcacagcagcatattgtctctatctaaccaaagcggctggattcaagctaaaaacagctcccacaacatccatcatgatgaacctcatatcgttcacttggctatttatgacgtatggtgcgcagcgtgccagcaggccgctcctctttaccaggcagtcaattaacgtaaaaaaagaccgggccgtaagggattcccggtcttttatattattttgtttcacggtgaagggtatatttctttaaacgcggtgaatattttttcagctccaaacggtctggattggtgcgtttattttttgttgtgatgtaatttcggtctcccgtttcagtgcaggctaaagtaacatttactctcataattaacatctccttataaagcgtaatgattacgttttattatacaacgtcatcacaaattgtcaaataagagctccgccttcagcctcgcgggacgtttacctctaagaaatcatatgccgccacgctattggggaaaacgtcaaccgcttctttttgaagctccaaagaagcatctccctgatatcttgcgctgatatgggttaaaatgagctgcttcgctcttgcttctttcgctgttacagccgcttgttccgttgtactgtgataataatcataagcaagtttacggtcttccttagcaaaggttgcttcatgaacaagcacatcacaatccctcgcaagctcttttagtttgtcacttactctcgtatcaccggagaacacaacagatcttccctttttaggaggctccagaaaatcattcccattgatgattcgtccgtcttcaagcgttaccgtttcgccttttttgattttctgatatacaggtccgggcgggatgttcatttcttttaatacgtcagccttcaaggaacccggtacgtctttttcctgcacacggtacccgaaggcttccactccatgaataacagataccgctgtgacaataaactgatcgtcctcaaacacgattccttcttcaatttcctggatcgcaagcggatatgtcaaatgggttttcgtgacggcaaggcttgtttcaataaacgccttgatccctttaggtccgtacactgtcagctcgtcctctccgccttgaaaggaacggctccccagaagccctggaagtccgtatacatgatcgccgtgcatgtgtgtaataaagattttctctattttacgaggtttaatcgttgtatgtaaaatttgatgctgtgtggcttccccgcagtcaaaaagccataccgaacgcctttcttcaagcaattttaatgccaccgacgttacatttctcgccttggcggggatgccggctcccgtccctaaaaaaagtaattccacgtttccttcctcctactagaaccagatacctacaagaatacaggatcaagctcaaaatgtgaatcttgcctctgaaaagaacaatcctttcgtgctagaaacattttttcagcattctgcttaaaaaagggcttaaatgtttgctttcgttgaattttagatttaaaatgaaggaaatatacggggtgtactaaaataaagcttcgaataaagtgaggtacttttagtgaaaacaaaccaacaaccaaaagcagtaattgtcatattcggtgcaactggagatttagcaaaacgaaaattgtatccgtctattcaccgtttatatcaaaacggacaaatcggagaagagtttgcagtggtaggagttggaagaagaccttggtctaatgaggatcttcgccaaactgttaaaacatccatttcctcatctgcagataagcatatagatgatttcacgtctcatttttactatcacccgtttgacgtgacaaaccctggttcttatcaagagctaaacgtattgcttaaccagctggaagatacatatcaaattcctaacaacagaatgttctacttggcaatggctcctgaattcttcggaacgattgcaaaaacattaaaatcagagggtgtaacagctacaaccggctggtcccgccttgtcatcgaaaaaccgttcggccatgatctgccaagcgcacaggcattgaataaagaaatccgcgaagcatttacggaagatcaaatttacagaatcgaccattatctaggcaaacaaatggttcagaacattgaagtgattcgatttgccaatgcgattttcgaaccgctttggacaaaccgctacatttcaaacattcaaatcacatctagcgaatcactaggcgttgaagaccgcgcaagatattacgaaaaatcaggcgcccttcgcgacatggtgcaaaaccatattatgcagatggttgcccttcttgcaatggagccgcctatcaaattgaacacagaagaaatccgcagcgaaaaagtgaaggtgctgagagcactgcgtcctattgcaaaagacgaagtggatgaatactttgtgcgcggacaatatcaagctggtgaaattgacggtgtaccggttcctgcttatacagatgaagataatgtcgctcctgactccaatacagaaacctttgttgccggcaagctcctgatcgacaacttcagatgggctggtgttccattctacatcagaaccggaaaacgaatgaaagaaaagtccacaaaaattgtcgttcaatttaaggacattccgatgaacctgtactacggtaatgaaaacaacatgaatccgaacttgcttgtcattcatattcagcctgacgaaggcattacgctttacttaaatgctaaaaagcttggcggagcagcacacgcacagccaatcaaactcgattattgcagcaattgcaatgacgagttgaacacccctgaagcatatgaaaaactcattcacgactgtcttcttggcgatgcaacaaactttgcacactgggatgaagttgccctttcttggagctttgtcgactctatttctgaaacatgggcagcaaacaaaaccttatctcctaactacgaatcaggctcaatgggaccgaaagtatctgatgatcttttggcgaaagacggcttacactggtggaatatataataagaagaaaaaagccgaaaatgtttacaagcattttcggcttttttgcagctgtcacagaggtatagcactctcattaataacaaaacccccgaagctctatagctttgggggtttctattgattacttcatccattcagtatggaagatgccttctttgtcagtacgctcatacgtatgagcgccaaagtagtcgcgctgtgcttggattaagtttgcaggcagtacggctgtgcggtagctgtcatagtaggctaatgcgcttgagaatgatggcaccggcacaccttgggcaactgcaagtgaaatcacttggcgaagcgctccttgatagctttctacaatattcttgaaatagctgtcaagaagcaggttgtcaagctcaggctcgcgatcgtaagcttctttgatcttctgaaggaatgccgcgcgaatgatgcaaccaccgcggaagatcatagcgatttcaccatatttcagatcccagttgtattcttcagaagcagctttcatttgggcaaatccttgcgcgtatgaacagattttactcatgaacaacgcttttctgaccgcttcaatcagctcttctttattttctgtaacaggcttcacttctggtcctgaaagaagtccgctcgctttcacacgctcttccttcatagctgagataaagcgtgcgaatacagattcagtaataatcggaagcggaacgcctaagtcaagtgcgctttggcttgtccattttcctgttcctttttgccctgctttatcaagaatcacatcaacaagcggcttgcctgtctcttcgtctttttttgtgaagatgtcagccgtaatctcaatcaggtagctatcaagctcacctttattccattcagcgaaaacttcatgaagctcatcagcagaaaggcccagcacctgtttcagaatgaaatatgattcagagatcagctgcatatctccgtattcaattccgttgtgcaccatttttacgtaatggccggcgccgtccggaccgatatatgtcgtacaaggttctccgtcaacttttgcagaaatggcttcaagaatcggttttacaagctcatgtgcttctttttgtccgccaggcatgatagaaggtcctttaagtgccccttcttctccgccggaaacgcctgttccgataaaatgaatgccgctttcagcgagttctttgttacggcgctgtgtatctttatagtatgtattaccgccgtcaattaaaatatcatccttctctagatgaggaagaagagattgaattgtcgcatctgttgcagttcccgctttaaccattaataagattttgcgcggtgtttccaaggattggacaaattcttcaatgctgtatgtgccaacaacattttttccttttgcctcctgtaaaaactcctcagttttactgcttgatctgttgtaaacagaaacagaaaatccccggctttcgatatttaaagccagatttttacccatgaccgcaagtccgataacgccgatttgttgttttgacatattctaacgtcccttctgcaaacgtttaatcattttaaaatttaaattaaaataaaatgatatttataataaagaaattaccatacattcaccctttttttcaagcgattcagcttttcttttcatcatgaaaaaaatctttattaaagcttgttccctttgttttgctctcctctttttttaacgttgccccttttctgatcagtttggtaccgtactttttattcagcttttccatcatctgctgaataggctcatccttcgcatcttcattaaagctgaacaaatcgagctgtttataggcctgctctttttctactaaatccgttccggtaatgccaagcagcctgacaggatttttattccagtgtttaaaaaagaggtgctccgcttctttcaaaatgtcatttttttgatcaatcgggtttctcagcgtggtgcttcttgtgatggttttccaatccgcatatctaatcataataaaaagcttcgaagccatgacttccttgcgctgtaaacgggcactcacagaagcagcaagctttctaaagacgcctaacagctcttcttcatcactggaatcatgggaaagtgtcgatgagttgccgacgcttttaaattcgtaaatgcgctccgggtcaaccggcgcatggtgaatgccatttgctttatttttaaggcgcggaccgtttatgccaagcaggcgtttcagggagtgttcatcagctgcagctagctctccgattgtatggatgccgagtcccttcagtttttccgctgtctttttgccgactccgtgcatctctccaacaggaagcggccacaggatatcaggcacttgcctctttcttaaaatcgtaattccaagcggttttttcatatcagacgccatcttagcgagaaatttattcggtgcgatccctatgcttgacgggagcagcagctctttttgcagcctgctttggatttcttttgccgtctctagcgcgcggctgctgtatggtgtatcggtcatgtccatatagccttcgtcgatggagacaggctccaccaggtcagtatattcacgaagaatggtaaacatcgctcgtgaagagtttctatagcggtcaaagttcggcggaagaacgatgagctcagggcaatggcgcttcgcttgccaaaccggcatcgttgttttgacgccgcgcgctcttgcttcgtagctgcatgttaccacaatgccctttcgctcctttacgtttccggcaactgcgaccggctttccccggagagccggatcatatgccatttcaaccgacgcataaaagctattcatatcaatatggaaaataattcggctctttcccggcataaacaaatctccttttcggtcattagacaacagcttgtacatatagtaaaatgaagctattgaatggatgtgatgacaatgtttgtggaatcgataaatgacgttttattcttagtcgattttttcacaattattcttcctgctctgacggcaatcgggattgcattcctcttacgagagtgccgtgcgggcgagcaatggaaatcaaaacgaacagatgaacatcagacggtctttcacattaaccgaacagactttcttattattatatatcatcgcattacaacttggatacgtaaagtcttccgcatgaattcgcctgtgaacgatgaggaagacgccggttctcttcttttataaaccgcatttataaaaaggaggagaacaaaattgttaaaaacatatcaaaaacttttggctatgggtatctttttaatcgtattatgctcgggcaatgctgcatttgcagcgactaatcaggtgggaggcctcagcaacgtaggttttttccacgattatttaatcgaaccgttttccgctctgcttaagggtgttgccgggctgtttcacggagaatacggactctctattatcctcgtaaccattattgtgcgtatggttgtactgcctttgtttgttaatcagttcaaaaaacaacgcgtgttccaagagaaaatggccgttattaaacctcaggttgacagcattcaggccaaattgaaaaaaacgaaggaccctgaaaaacaaaaagagctgcaaatggaaatgatgaagctgtatcaagagaacaacatcaatccgcttgctatgggatgcctcccaatgctgattcagtttcctattgtgattgggttttattacgcgattcgctctacacctgaaattgcgtcacactcgtttttatggttcagtttaggacaatctgacattctcgtgtctcttagcgcgggagcaatgtactttatccaggcctatgtcgctcaaaaactgagcgcgaaatattccgctgtcccgcaaaaccctgcggcacagcaatccgcaaaattgatggtgttcatcttccctgtgatgatgacgattttctcgcttaatgttccggcagcccttccgctgtactggtttacaagcggactgtttttgacagtgcaaaacatcgtccttcagatgacgcatcataaaagtaaaaaaacagccgctcttactgagtcggtgaaataaaaaagcaaccccgcgcgaaaagccggggttgttttttgttacttgcaaagcataccgcgccaaacagtcttgtttatcatagctgaagcagaaatggccatccaaaaaatagccgtatcgtttaaaaagaaggaaatagggaatacctttactcacctccaaacgaaaggagcatatacgttgacggaacactttcagcaaaaaaacatttctgtacctgatggaatctggatcatgagacaaacctggaatgatgtcttatttgctcactggcctgttgatgtttctatccttcgcgctttggtaccgtccgttttagaattagatacatataacgggcaagcttggatcagcatgcttccctttatgctcacgaacctaagggcgcgttatcttcctgccattcccggtgcgcgtgcatttcctgagcttaacctccgcacctatgtcacgtataaaggcaagcccggcatttatttttttagcttagatgccgatcatcgtctggcggtccttggcgctcgcacattctttcatctgccttatttttacgcggatatgaagtccgaaaaaaacggtgatgccattgactatgtcagcaagcggaaaaatgacaaagaagcagcattccacgccgcataccggcccatttcagcgccttttacagcagaaaaggattcgctcgattactggctgacagaacggtatagactctatactaccaatcaaaacaaactctattacgaagacatccatcatcatccatggctgctgcaaaacgccgaagcggaaatttcagtcaatacggtgactgatgctcacggcattacattgccagagtcagaccccttgcttcattacgctaaaaaacaggatgtgttattttggccgcttaggaaatggagctaaaaaaacccgatgcgggaaatcgcactcgggttttctttttttattttgccgcctcttcaataatggcaacaaccatttctgccgttttaacgagctcttcgatcggcattttttcattttttgtatggatttgctcataaccgacagcaagattgaccgtcgggatgccatgaccagcgattacgttcgcgtcgcttccgccgccgctcgtttgcagctcgcttggacgtccgattttagcagccgcttttttcgcgatttcaacaacttggtcgccgtcttgatatttaaagcccggatacataacctcaatttcgacttctgcgcgtccgcccatatcagcagctgcctcttcaaaagcagctttcattttttgaacctgagcttccattttctcaggaactaaagagcgcgcttcagcaagaatatgaacttcgtcgcacacaatgtttgtttgtgtgccgccttcaaaccggccgatattagctgttgtttcttcatcgatacggcccaatggcatttttgaaatggctttgctagcgattgtaatcgctgaaatgcctttttcaggttcaaccccggcgtgagcggttttcccgaaaattgccgctcttaccttcgcctgtgtcggcgcggccacaatgatatttccgacttttccgtctgaatcaagagcatagccgtaggatgcagtgatcatagaacggtcaagcgccttcgctccgatcagacccgattcttcccctactgtgatgatgaattcaatcgtgccgcgttcaatgttttcttctttcagcaccttaatcgcctcaaacattgcagccaatcccgctttatcatcagcgcctaaaatcgtcgtgccgtcagttttgacgtaaccgttctctacaactggttttacgccgtttccgggtacaactgtgtccatatgagatgtaaaatagatcgtatctgtttgttttgtcccttttagcgtgcaaatcaggttaccggctccgtggcccgtgatatccattgtatcgtcttctttaacgtccacacctaaatcagaaaattttcgtttcagcactttgcagatttcagcttcgtgctttgtttctgagtcaatttggacaagctctaaaaattcttccagcaggcgtttttcattcaccatttgtaagtccctccatattaaagcggtatgttaccgtgcttttttttcggtctctcttctgtcttatgtgcaagcatatgaaaagcttgaatcagttttccccttgattcttccggcaaaatgatgtcatcgaccattccacaagctgccgctttgtatgggccggcgttttgctttttgtattcagctgttttttcgcgtttcgtcttttgcgggtcagctgaagctttgatttccttttcatacaaaatcgatgccgcaccttctggacccatcactgcgatttcagcattcggccatgcaaacacaaggtccgctccgatcgctttgctgttcatggccacataggcgcctccgtacgcttttctaatgatgagtgtgacttttgggacagtcgcttcagcataagcaaacaataattttgctccatgcctgatgattccattgtgctcttgctgaatacccggcagaaaccccgggacatcttcgacagtcaatagcgggatatcaaatgcgtcacaaaaacggatgaaccttgctgctttatcagcagcgtcaatcgtcaggcttcccgccagatgcttcggctggctcgccacgatgccgattgctttttcacccagccttgcaaacccaatgacaatgttcttcgcaaaaaatggctgaatctcaaaaaaagattgcgggtcagccagctccctaatcaccttccgaacatcataagcctttgtcgtatcagcagggacaagacggtttaataacggtctggacgcctctttctctggcttcggctctgttgtccggccattcagcggcaaataagacagcagttttctcacccctgtcagaacctccttctccgtatgcccggaaaagtgggcgtttccgctgacggcattatgtatccccgctccgcctaagctctccgcatcaacctgttcccctgtcactttttcaatcaccttcgggccggtaataaacatccggccggtctgttcagccataaatataaaatctgtgagtgccggagaatatacagcgcctccagcgcacggccctaaaataaccgatatttgcggaatgactccggaatataagacgtttcggtaaaatatgtgaccgtatccatctaatgataacacaccctcttgaattctcgcaccacctgagtcattcagcccgataatcggcgccttattttttgctgccagatccatcaaagcgcagattttcctggcatgggtttcgccaagcgcccctccgtacactgtgaagtcttgcgcaaatacataaactgagcggccgtcaattgtgccataccctgtcacgaccccatcccctaacatgcgctgttctcttgttaacacttgactttccatgaaggggtgtaattcgataaagctgtcctgatctagaagaaatatgatcctttcccgagcagtgtgcttgcccttttgccgctgctgagccagcttttcccgtcctccgccttcttctgcctgcttgcgtttcgtgtataaatgatccatgtgttcattcatgctcattgtgttggtctcctttcggttcacaaagctctacaagaacaccgtttgtttcccgaggggaaataaacgcgatctttttcccgttcgctccctgtcttggaaacctgtcaatcaattgaacatgctggtcagacaatgcttgaagctgttcagataggccgttgcacaaaaacgcaatatgatgcagtccctgccctttcttctccaaaaataaatggacggggctgtcagctgtcaacggctctatcagctcaagtttgacgctaccagcttgaaaaaaagcaacattcaccttttgctcttcaaccgtttcttgatgaagaaatgcaagccccaatacattttcataaaagcttcttgcatcttttatcgaaaaaacggctatcccgatatggtcaagcctgttcattttcatccctgctttcgctaatagatatcgcttgtccgcccattcaaaacacgctaaaatatagacagattgtttaaggagtgaaaatcatgtctcaaaaactgatgaaaagcgttttgatcgtgattttgggagtttttattctttcaactgtactctcaggaatcgtcatgtttctataacgataaaaaagcaggcgccttattcaatgggaatatcctgcttttttatcagagctttatgctcgatggcaatctcctcaaaagagcggttgtcgtccgtgatcagcactctcgttcctactggtatcgtttgaaacaaatgaacaacctcatcgttatgcatacgtatacagccgttagacacaaattttcctactgattcctctcggtttgtcccatgaattccataaatccgcccgtccgttcctttcgcgtcaaatccgatccatctggccccaagcgggttatcaggagatcccccttcaatatttttctttctgtagtaaggattttccgcttttaccgttaccgaaaactctccttcaggcgtcaaatcatctgtttttccagtcgccacactatacacgccttctactttgttgtcgagaataacagcaagttcatttgttcgcttgttgacaataacatacggatcacctggcagcggattttcgccgagcggccaaatcggtgaaatcatcattaaaatcgaacataagaaaaaacgcataagctcctcctttttcattaggttgaccaatgaaggaagagctcatgcgaatcatccgagtgatttttgcgcttttattcctttaaaataacttttaatcactaaatattgttccatttcgccgagaagatggaagagagcggccctcgcttcaaattcctctctagtcgcaggaagcggcatctcctcaaattcttttctcatgtcagcaagtcttttcagaaatttgtacgctgtattcccagggtgtatcgcctcccgcaaatcatgaataaattcagcgatcatttttccctgatctaccgtgatggagatcgatgtcactttagggagaaggcgttcgataatttcaaattgcttttctctcattttaaaataatgataatgcagattttcgtaacgcaaaatgtggttttgcacatctcgatatgccaggtttttagcctccgtaatgagctggtgcgtttccggaatttcttttcctgaccaatcttgctcaccagttaacaaataccgttcgatttctgcaaaaatgacagcaaagttatcctctatctttttgcggtaggcaatcagtttccggtcaagactaggcatatacaagttcatcaatagagcgacgccgatgccaaccgtaatcagctgaacttcattccagatgaaagcaagcgtaatgccgccggacatgtataaatgaaggataataacggaactggtgacgataccctcgttaatttttaacagaaccgttatcggaatgaatatcaaaagaagcgctccgatcacaaacgggtggtagccaataagctcaaaaaagagataagaaaaaacaattgccagacagcatgccgcaaagcgggcccatgaggcctgaagcgaccgtttttgtgtgatttgtatgcacaaaatggtgatgattcctgctgatgcgaagttttgcaaatgcaataactggcttatataaatagccaaagctgttccaagcgcggtctttattgtgcggtaaccaattttaaacatgtcggactccatttctatttgtttcttcaataaaaaagaagaggcggccagccttcttcttttttatattctataatattttctctaaaaagtcctgcgctcttttggattttggcgacataaaaaattccttcggattgccgtcttcgacaatcattccttggtccataaacagcacacggtctgccacttcttttgcgaagcccatttcatgtgtgacaatcaccatggtcatgccggtttcgaccagctctttcatcacctgtagcacttctttgaccatctctggatcaagggcggaggtcggctcgtcaaacagcatgatgtccggattcatcgcaagagccctggcaatcgcgacacgctgtttttgtccgccagacaaacggtttggatagtcatttcgcttttcaaacaaaccgactttgcggagcaggtcctcagctttctcctgtgcagcctgttttgattctttttttacattgacaggcgcgtacatgatgttttcgagaaccgttttgtgcggaaagagatgaaaatgctgaaaaaccatcccgatgttttcccggacctttaatgtgttggttttcggcttcgtaatctctgtgtcttttattgtaatggttccgccgttaggcttttccaacaggtttaaacagcgtaagaacgttgatttgcctgagcctgaaggaccgatcacggcaacaacctcaccctcagcgattgttgttgaaatgttttttaatacttcgtgtttcccaaatgattttgacagcttttcaaccttaatcattggatttcagcttcctttctacagccttgccgataaacgttaaaatcaggacaagcacataataaatcaatcccgcgataatgagcggctcaaggtaattgtaagtggcggcgccagcttgatatgcgcgtctcatgacatcaccaagcccgatgacggtgacgatcgccgattcttttgttaacgtaattaattcattcacaattgcaggtgatatatttttgaaggcctgcggcagcagcagatccttcatcatttttccatacgggacaccgagtgcaacagcagcttctttttgccctttatcaatggcattgattccggctctgataatttccgatacataagcggcggaattcaaagacaatgcgacaaccgcagcccaaaactggtcaatttgaaatccgagcagctgaggaaggccaaaatagacaatcataagctgcagcactaaaggcgtgcctcggaacactgatgtataaaaatcagcgatccagataaacgggcggaatgtgctgatcttgcataagcttagcacaataccgagtataagtccgataatagcagatacaacaacaatttttaatgtaattgccaagccttctaatataaaaggaatttgggggatcgttgctgaaaaatccaaattcatagcctttgtctccttttcttacaggaaaaaagtttcctattcaataaaaaggctcaacgaaaaagttgagccgcttttttttacttctcgccagtgaaccattttttcttcaatttctcaagctctccgttatcttccatttccttgagcgctttattgaatttgtctgtcagttcactgtcctttctgaaagcaattgctgaaccggcttcttccgctttcgcctcaggaatcacaaagccttgcaggtcatcatttgatttgaaatacccttctgcaacaatgtcttcaataatcgcggcatcgaaacggtcagatttgatttcctgcaccaaatcagaaattctgttgcggtcttctgttttaaaaccatattccggagaaagctctttccccttctcttcctgaatagagccaagctgaacgccaactgtttttcctttcaggtctttcaaagattgaatgccgctgtcttttttgctgacaatcatatggttcgctgtgtaatacacatcggaaaaatcaacttgttttttacgctcaggcgttggtgtcattcctgacagaacgagatccacctgttttgatttaagcgctgtaattaagctgttgaagtccatatcctgcacttcaatttcatagcctgccttctttgccagagcttttgccagctctacatcaaagccgacaatattatctccttctttatattcaaacggtttgtaatccgccgaagtacccataattaattttttctttccgctttctgaacctgaattgcttgagccgcacgcagttaatgcaaaggtgatgcaagcagctacaagtaataagagccattttttcatgatccatttcccccgtattcattacttttggtgtatttgaatatttattcgttaatttgtattttaaacagtttctcatttttatgcaatactatttttaaaaattatctttaagcttatctttccagtgatctcttctgatattactagataaaaattaaatcgctgtacaatccgattgaataatcccttaatatttattcatatatccttagaaatttatgcacaaaaaaacccgggctgctttgagcatccgggttgttcgtcttatacttcttcacaatattcttcaaaggcttcctgcagctttgccactacggccatcggctcatggccttcaatttcatgacgctctaccattttcatgatctttccgtctttcaaaatcgcaaaggacggagaagatggcggataaccttcaaaatagtcacgcgcacgcgctgtcgcttctttatcctgtccggcaaaaacggtgacgagctgatcaggtcttttatcatagtgaacggaatggtaggctgccggtcttgcaattcctccggcgcatccgcaaacagagtttaccatgacgagcgtcgttccttttttcgtaagtgcctcatccacctcttcggctgttttaagctcggtgtatccggcagctgttatttcttgtctcgcttggcggacaatatcattcataaataaattaaagtccatgttcaatgaagacctctcctttttcatcatctgttcttatgatagcaaggaaacgtccatatcggcaaatgactttgcttcgccgtgcactttttttgctcttcgtttactgcttacagaaaaaggggattatataactagaagtaaaataaaggagcagttgtatatgagccacaggaaagcgttactgattcataacggaaatgccggcaacaaaaatatagaaaaagcacttggtgctgtggtgccggttttatctcaccatttagatgaggtaattattaaacagacaaagaaaaaggatgatgcgtatcatttttgccgatccattgatgattctgtcgacaccgtcttcattctcggcggcgacggcacgatccatcaatgcataaatgctatcagcgctctagaaagaaaacccgcggtcggaattttgcccggcggcacgtgcaacgacttttcaagagtgcttggcatccctcaaaatcttgcaaaggctgcggaagcacttatgtcaggaaaaaaaaccagcgtagacgtatgtcagatgaatgaccgttattttttgaatttctgggggatcggcttaattgcagaaacgtcgaatcaaatcaacgaaacggaaaaagcattattgggaaaaatcagctattttacaagtgccttgcgaaccgtctcatccgctgcatcgtttccgatgacattaaaaattgatggagaagaaattaaagaagaagccgttatgctgcttgtgatgaatggccaatatattggaacgaatcgaattcctctccccgatgccagtattgaagatggcttacttgatgttctcatatgccgcaataccaacctcaccgcgttgcgggagctgatgagcatggaacagggttcaattgatcgttttaccggagagttgtcctatgtccaggcttcccgtatcgagattgaaacagacactgccaaaaaggcggatatggatggagaagtttatacacatacacccgcagtcattcaggtcctgccgcagcatatcgacatgcttgttcccgcaaatgaataactgtcatagggctttagaaagattttgcaaatccgttgactctcccctaggaggaggtcttacagtataagggatacacacttgaaaaaggggaagtcatatggagaagaaaaatattaccttaactatattattaaccaatttatttattgcttttttggggatcgggcttgtgattccagtaacgccgaccattatgaatgaattgcatttatcggggaccgcggtcggctatatggttgcctgcttcgctattacacagctcattgtctcaccaatagccggacgatgggttgatcgcttcgggcgcaagatcatgatcataatcggcctgttgttctttagtgtgtcggagtttttgttcggcattggaaaaacagttgagatgttatttatctcccgtatgctgggcggtatcagcgcagccttcattatgcccggggtcacggcttttattgcagatatcacgaccattaaaacacggccaaaagcgctcggttatatgtcagccgctatttcaacaggatttattatcggccccggcatcgggggatttttagcagaagtccattcccggctgccttttttctttgcggcagcttttgcactgttagcagccattttatcaatcctcacgctgcgcgagccggaacgaaaccctgaaaatcaggaaataaaaggacagaagacaggctttaaacgaatttttgcccccatgtatttcatagcttttctcattatcttaatttcgtcttttggtttagcatcatttgaatctttatttgcattattcgtggatcataaattcggatttacggccagcgacattgccattatgattacaggaggagcgattgttggcgccattacgcaagtcgtcttattcgaccgcttcacaagatggtttggcgaaatccatttaattcggtacagcttaattctctctacgagtctggtattcttgctgacaacagtacattcatatgttgcgattctgttggtgacagtcaccgtatttgtcggatttgatctcatgcggcctgcggtaacgacttacctgtcaaagattgcgggaaatgaacaggggtttgccggcggtatgaattcaatgtttacaagtatcggcaatgtattcgggcctattatcggcggaatgctgttcgatattgatgtaaactatcccttctactttgcaacggtcaccttagccatagggattgcactgaccattgcttggaaagcgcctgcacatcttaaagccagcacgtgataagaagcgcattctttgtgtactgcaaagatgcgcttcttctttatactgatgatagaaggagtgatggcatgaaggaatcgtattactcaattggggaagtatcaaaactggcaaacgtgtcgataaaagcgctccgttattacgataaaattgatttatttaaacccgcctacgtcgacccggataccagctaccgctattatacagattctcagctcattcatctggatttgatcaaatcattgaaatatatcggcacacctttagaagagatgaaaaaagcacaggacttagagatggaagaactgtttgctttttataccgagcaggagaggcaaatcagggagaaattagactttttatcagcactggagcagaccatttcattggtgaaaaagcggatgaaacggcagatggaatatcccgcgctcggtgaggtgtttgttttagatgaagaagaaatacggatcattcagacagaggcagaaggaatcgggcctgaaaacgtgctcaacgcctcctacagcaaattaaaaaaatttatcgagtcagcagatggatttacgaacaatagctacggcgctactttctcttttcagccctacaccagcattgatgaaatgacttaccgtcatattttcacgcctgtattgacgaataaacagatttcatcaattacgtcggatatggaaatcacaacaatccctaaagggaggtatgcgtgtatcgcgtataatttttcgcctgaacattattttctcaacttacagaagcttatcaaatatatcgcggaccgccaattaacagttgtcagtgatgtatacgagttaatcataccgattcattactccccgaaaaaacaagaagaatatcgagtcgaaatgaaaatacggatcgctgaataataaagcatagaaaaagagcattttttgaaacaaaacttcaaaaaatgctctttttgcttatttagtaaacagatgtcttctcgtcaatcgattctaaaatttgtttcactcgtccgaggaatcgtccgcacacgagaccgtcaagcactctgtgatctaatgacaggcacagattaaccatgtctctgacagcaatcatgccattgtccatgacaaccgggcgtttgacgatggattctacttgaagaatcgcagcctgagggtagttgataatgcccattgactgaacagagccgaacgaacctgtgttgttgacggtaaacgtgcctccctgcatgtcatctgcagtgagttttccgtctcttacttttttagctaggccggtaatgtctttcgcaatgcctttaattgttttttcatcagcgtttttaatcaccggaacaaataaagaatcctctgtggcaactgcaattgaaatattgatatcctttttctgaataattttgtcccccgcccacatgctattcatttgcgggaattcttttaacgcctgagcgaccgcttttacaaaaaaggcgaagaacgttaaattaaagccttctgtcttcttaaaggaatcttttatactgttgcgatatgcaaccatatttgtgacgtcgacttccatcatcgtccaagcatgcggaatttctgttttgcttcgcttcatattggaagcaattgcttttcttacacctgtgacagggatttctttatcaccggctgcagacgcaggatatgacgtctcttcttttggctcaggttttgatgcagacttcggtgcaggagctgctgttttcggctcctcaggattctgttcttgcacgccgcctgtttcaattaagcgctgaatatcttttcgtgtgatgcgcccgccggcacctgttcctgttacttgttcaagatcaatgctgtgctctccggccaaacggagtacagctggcgagtagcgctttttattgggctgatcagctgcttcggtactttttgcagcaggcgtctcagcggcttttgaagcagctggctgttcttgtttttgttcagccggattcgcgccttctgtttcaattttgcaaatcacttctccgacttgcagggtttggccttcttctcccacaagctctgttatcgtaccagtaaaagaagacggaacctctgcatttaccttatctgtcatgacttccgcgatcggatcgtatttgttcactttatcaccgggggcgacaagccatttgctgatcgtcccctctgttacgctttctccaagctgcggcatcgtcatttgttcaattgccatgattgtatcctcccttacgtctttaaaactccgctaattctctcatcgccgcttccactttatcagggttgaccataaagtatttttccattgtcggcgcataaggcatagccggaatatcaggacctgcaagccgtttgatcggcgcgtctaagtcgaacagacaatgctcggatataattgcggctacttcgctcatgatgctgccttcttttgtatcttctgtgaccaaaagaacctttccagttttggacgcagcttcgataatcgcttctttatcaagcgggtaaactgttcttaaatccaccacatgcgctgaaatgccatctttttcgagacgttctgcagcttgtaaggcaaagtggacacacagaccgtatgtgatcactgtgatgtcgtcgccttcccgttttacgtcagccttgccgattggcaggacataatcatcagccggaacctctccctttatcagacggtacgcccgcttgtgctcaaaaaacagcacggggtcttcgtcacgaactgcggcttttaagagccctttcgcgtcatatggtgttgatggcatgacaattttcagtccgggctggttggcgaaaattgcttcgactgattgagaatgatacaaggctccgtgcacgcctccgccgtatggcgctctgacgacaatcggacaactccagtcattgttgctgcggtagcgaattttagctgcttcagaaataatttggttgactgccggcataatgaaatcagcaaactgcatttcagcaatcggtctcattccgtacattgccgctccgataccgactcctgcgatcgcagattcagcaagcggcgtatccatcacgcgctcttccccaaattgttcatagagtccggctgtcgctttaaacacaccgccttttcttcctacatcttccccaaggacgaagacgcgagaatctcgttccatttcttctttcatcgccaaattgattgcatcaatatatgacattactgacatttgttcttcctccctacttcgcatacacataatcaagcgctgactcaggagctgcataaggggcgttctccgcttcatccgtcgcttcatttacgattgccataatttcatccagcatggtttgttctatctcatcggacagcaggcctgtttcctttaagtaagcttgataagtaagcaggggatcactttttttcgcttcctctacttcttcacgccctctgtagctgctgtcatcgtcatcactggaatgtggtgtaaggcggtaagaaatcgtttcaattaatgtcgggccttctcctctgcgtgccctttcgcgtgcttctttaaccgcttgataaacttccagcgggtcatttccattcacagttacgccaggcatcccatagcctatggcacggtcggaaatgttctcacatgcgacttgcttatcgtaaggcactgagattgcgtatttgttgttttcacacataaaaataaccggcagcttatggacagcggcaaagtttgccccttcatggaaatcgccttggtttgaagacccttccccgaatgtaacaaaggctgcgatatcctttttctccatacgtcccgcaagcgcaataccgactgcgtgcggcacttgcgttgtaaccggagatgatcccgtcacaatgcggtttttcttttgtccgaaatgtcctggcatctggcggcctcctgagttcggatctgctgcttttgcaaacccggacatcattaagtcctttgctgtcatgccaaacgcgagcacgacacccatgtctctgtagtacggcaatacataatccatttcacggtcaagtgcgaaagccgctcctacctgtgctgcttcctgtccttgacaagagattacaaatggaattttgccagaacggtttaacagccacattctttcatcgatttttcttgctaacagcatggttctatacatatcaacggcttcctgatcagtcagccctagtgcttgatgtcggtttatactcattcaagcccctcctttatgcttttaaaaatgaatggctttgccatctgcggcaagcgctgcttctccaattgcttcagaaagcgttggatgcgggtgaatcgtttgcccgacctcccacggcgttgcgtccagcactttggcaagacccgcttcagaaatcatgtcggtgacatgcgggccgatcatatgaacgccgagaatatcatctgtatctcggtccgccacgattttgacaaaaccgtcgctttcaccgtatacaagcgcttttccaatcgccataaatgggaacttgccgattttgacattatgcccgttcgcctttgcttcgtcttctgttaagccgacactggcagcttcagggcttgagtaaatgcacttcggcacaagcgtcggatcaagcggatgcggattgagacctgcaaaatgctcaacagcaataattccctcatgtgaagcaacgtgagctaactgcaggccaccgattacgtctccgattgcataaatatgagattccttcgtttggcagctttcattgactgaaatcatgccattttcagtaacaatatcggtgttctctaggccgatgccttcgatatttgcctgtctgccgatggaaacaagcattttctcagcagagtaggtaacggtttctccgtctttttccgcttgtatgctgatatcgtctgatgtttttgtcattgtgtcaggcagcacttttgcccctgttatgaactggatgccttttttcttaagaagactttccatttcttttgaaatctctagatcttcagtcggcaatatgcgatccgcgtattcaataaccgttaccttcacaccaaaatcatgaagcatagacgcccattcgataccgataacccctccgccgacaatgatgattgattgtggcagctcctccatttggagcgcctcatctgaagtcagtacagacttaccgtccgcttcaagacccggaagcattctcggtcttgatcctgttgcaatgatcacttgtttcgggatcagcatgtcattttcttcgccatttccccgctcaacagaaattgttcccggcagcggagagaagattgacggtccaagaatacgtccatatccggtgtacacgtcaatttttccttttttcattaaatgatttacacccgctgcaagcttatcaacaacggcttgcttacgctgctgcactttttcaaagttgagggacacgccagccgtttccaccccgaattgatcggcttcacgagctgtccggtatacctctgcgcttctaagcagcgctttactcgggatacagcctttatgcagacatgttcctccgagtttttccttttccacaacggctgtttttaagccgagctgagcggctctgatggccgcaacataaccgccggtaccgccgcccagaatgactacgtcatactcagttgccatggtgactcactcctgtctgtctattcaatacgatattgtttggattgctcttcgccctgcaatactctgagcgccccttgggcaagagactgcagttcattttcacccggatagactaaaacgtctgaaatccaatctatgtatgatctgatagcagaaacaaagcttttgccgtacgcaaggcctcccgtcagcacaatcgcttcaacttctccttttaacgctgcgctggctgccccgatttcctttgctacctgatatgccatggcatcataaatgaagcgggctttttcatcgcccccttgaatcatctgttccacttttactgcatcatttgtaccgagatagcctaaaagtccgccggtgccaacaagctttttcatgatttcttcttttgtatattcccctgaaaaacatagatcaacaagatctcccgcaggcactgttcctgctcgttcaggactgaatggtccctcgccgtgcaggccgttattgacatctaccactcgcccgcggtcatggacgccaattgtaatacctccgcccatatgggtaataatcattttcatgttctcatatcgtttgccaagagaggctgccgctttacgagcgacagctttttggtttaacgcatggaaaatgcttttccgttcaatttcaggcatgcctgaaactttcgcaagcactgacatttcgtctacgacaacagggtcgacgatatacgaagggatattcaggccgtcagcgatttcccgcgcgataatgccgccgagattagaagcatgctgaccggcgtaaccgcttttcaagtcctcaatcatgtcatcattcactacgtaggtcccgccttcaattggccggagaaggccgcctcttgcgcagactgcatcaaacttcgagatattgattccctgttcatgaagcgtttcgagaatatggtttttacgaaattcatactgatcaataattcggtcaaatcgctgcagctcttctatgttgtgtctcaatgttttttcaaaaatgcttctttcattatgaaaaacaccgattttcgttgaagttgagcctggattaattgtgagaatgcgtttttcgtcatgtagcactttcataacctccagatcaatttcttaacgtctgcttaatacactgtggccgttttgcaaaaactggcttcttgagcggcgcatgcgttcaatccgttcctctgccaagcggtcagccgctaaatatgcaggaatgccgtcacgctgagaaatctcaagtacacgctcgatattgccgtaaatgccttcaacttttttcaatgcacgttctgcattatagccgtaaagctcatctgccacgttgatgacaccgcccgcgttaatcacgtaatccggtgcataaacgatgcccatttcgtgaatttgatcaccatggcgtgtctcttttaattggttgttagccgcacctgcgatcactttcgccttcagctgtttaatggtgtcgtcgttaatagtcgcaccaagggcacatggcgcataaatatcgcagtcttgtgaataaatatcatcaggatctaccgcccgggcgccaaaatcttcaactgcacgctgtacagattgtttgttgatatccgtaacgattaagtttgctccttcttcatgcaggtggcggcaaaggttataggctacgttcccaacaccctgtacagcaatggtttttccttcaagagagtcggttccgaaagcagctttagctgctgccttcattcctctgtacaccccgtacgctgtgactggggacggatttccagaagagccgaaagcaggagaaatccctgtaacgtagtctgtttcatcatgaatgatatccatatcctcgaccgttgtacccacatcttcagccgtgatgtatctgccattcagcccttgaatatagcggccaaacgcgcggaacatttcttcatttttgtctttgcgcggatcgccgataatgactgtttttccgccgccaaggtttaagcctgccgccgcgttcttataggtcatgcctctagccaatctgagcgcatcttcaattgccgcttcttcattttcatatgtccacattctcgttccgccaagcgccggaccaagcgttgtatcatgaatcgcgataatcgcttttaatccagattgttcatcctggcagaataccaattgttcgtaatcgtatttctccatatatttaaaaagttccatgttcgttcctcctaatgtgtgtattcttcagatgcgcatattgccagcgcaatggaatacagtttattttcagcagagtccgctctgcttgttaaagcaatcggtgcttttgctcctgtaatgacagccgccacgctggccttggcaaaataaatcagtgatttatataaaatattgccggcctcaattgttgggacgagaaggatatctgcgttgcccgctacgtctcccgaaatttttttctgagccgcggcaatttgtgaaactgcgttatccaaagcaagcggtccatcaacaatgcagcctttgatctggccccttttgtacatttgagctagagcagctgcattcacggttgcttccatttttgggttcaccgtttcgaccgctgcaagagcagctgcttttggcatattgttccccactgcatgggccacatgaacggcattttgcaaaatctgccgaagctcttccagcgaaggagcaatattcattgccgaatctgtcacaaacatcagccggtcaaaatccggtatatcgaatacagccacgtgagaaaggacacttgctgaccgaagcccctcctgtctgttcaataccgctttaagcaaaacagaagtcggcacattgcctttcattaaaacgtccgctgttttatgatgcacagcacgaaccgctaatttcgccgattcctcaggagtatcggcatggacgatttccacttgatgcccttgcatggatgatgtcagctcgttcagttttgtgctgtcgcccgttaacaagaaacgggcagataggtgctcggctgccagctttacagcccggatcacttcctcatcctcagcatgagcaaccgcaatggtcttatttttgtgtatcgacgctttgccgattaaatctttcagcttcatctgttaccacctttcttgtttcgactccgccttttattatgcaagttccatgccagctcttaagggtgctgtcataccaggtatattgaaacattcgtgcagatgtttgcgtttattctgcaaattattgcatgccttcatttgcaaggccatatttatccattttgtaatataagttccgaatgctgacaccgagagcttttgctgtttttgtccggttaaaatgatgcttttcgagcgtttgctggatcaaatgtgcttcaaatttttctactgcgacagacagcttttcgccttcaatatccggaaaatcaaaacctgttccctgatctgtgtcattttctttttgctcaagttcgaatacaggcaagtgatctttttcaatccattccatatgcggattcagaaaaatcatggctcgtccaaggacattttcaagctcccggacattcccaggccaatggtaggcagataaggcgcgcaaggcttgttgtgagagcccttttacattcctgccgtaatcccggttgatcttttggataagtctgacgctcaatgcttcaatgtcctccaaccgctgccgcaaaggcgggatggagatcggatagcgattgatccggtaatacaggtcttcccggaatgttccgtccgccatcgccttttcaatatttacatttgtcgccgcaatcactctgacgttgacagggatcgctttcgtgccgcccactctgacgatttccttttcttgaaggacgcgtagcaatttggcctgcatattttgtgtcagctcaccgatttcatctaagaaaatactgccgttatttgcttcctcaaataaaccctttttaccgccgcgtttcgctcctgaaaatgcaccatcctcatagccgaacaattctgattcgagcaggttttcagaaagggctgcacaattcacgcgaataaatttattgtatttccggtcactttcgttatggatggcatgggcgaacagttcttttcctgttcctgattccccgcgcagcaagatggttgccggtgttttcgcaccgagcttcgcctgctcaagcgcaaccagcatttgctcgcttttgccaataatgtcgtcaaacgtgtatttcgcttcaagcgtgcgaataatttgtctggcgcgattaagctccgctgtcagcattttaatttcggaaacatcgtgaatcacgccgacgctgcctttcaaaatcccgtccacaatcaccggtgctacattaacgatgacctctttttcattcgggccgaccttcattctgacaccgcggacaggacgtcttgtttcaagcacctttaaatgcatgctttcgccttcggaaatatcagtgtttgcaggcttgccgatgacttctttttcagaaagccccgtcattttcgtatacgctttattgattagcaggccgatgccgttttcatcaacgacagaaatcgcctcatcggaggattgaataatcgcctccagcatcgtacggacctgctttaagttggtcacttcctctgccagctcgaccgcatcagtgatatctttaaacacacaaagagcaccgagcagacgtccgccttcatcaataatcggcagtcttgtggtcacaatttgcaaatgatcgcctaacagctgcttctggttgtattcaggcactcttgtttttaaaatccgcggcatcttcgtgctcggaatcacttcttttattgggcgcccaatgacttcctcacgtttttttccgaccattttttcggccatatggttaaagagaatgatttcttcattgatatcaataaaaatcattccatcatgggtggaattaaaaattctgtcatatttataggtttgctcttttagcatttgaatcaggtgctgcttttcttccatcagctgaaaaacgatgtatgccatttttcccggcatgacaatggtatcttcatgctttctttgaaggagctcgtcaaacacggcttgatcgccggtggtatgaatgacgatatccggtttttgttgtatgtaaggtttccaatcagatgatacggcaatcccatacttttctgcttctttcaatcccggcgcctcggggtctttgtcaactacggcaatgatatctatgatggctgttttaatcagaatatgtaataacgccgttccccttttgccggcacctactatcagtaccttttgcatcccgatacccctttgtatgaaaaaatttgcacacctatttattccgttgcaataatttgcacaaccctatgttaccacgttttcttctcttgacaaaatattttttccgctggacaataaaggaaatgaaaagataaaggggttttctgaagatgagccgacttcttgcgcttttaatattagtcatccccggggctatttctgctttaggcattaaactgatgagagatacacttttcggccatacaatcaagccattttcagctctttggctccaagggttgtcaggattcatcttttttgcgatcggcctctatgtgctggccgggttcattttatacagagacagaaaacgcaatcaagtcagctcgcgattcagaaaacgatagctgaaaaaaagccggagaatgctccggctttttttgttgcattattcgtcaggcaaaacggtcttggcaatcgttttgtctaacgcttcatagtcataataagaaatcgtatcgtacagttcttttcgtgtctgcatatcatgaagtccttctttttgtgagccgtgctccttcatcaaaccaaacatccgctcacaagcttttgccgccgctcgaagcgaggtgacaggatatatcaccatgtgaaaccccatatcttcgaattcatcggcacgataatatggcgttttcccaaattcagtcatattcgcaaggagcggaacggggatacgctcagcaaactggcggaattcattctccgcctgtagcgcttccgggaaaattgcgtccgctcccgcctcaatgtaagcctctgaacgttttattgcggcatcaagcccttcctgcgccctggcatcagtacgggcaacaacaataagggagggtgccgcttgtttaatggcttttattttttgcgccatttcctttatcggaactagctgtttgccatttaaatgtccgcatttttttgggagctgctggtcttctatttgaacggctgctacccttgcttcaagcatctcccgggctgttcgggcggcatttaagacaccgccaaatcccgtatcgatatccacaagcagaggcagatcagctgcacgtacaagatctttggcccgttcagctatctctgccgatgtgatgatccctaaatcaggcagccccctgctggctgtataggcagcaccggacaaataaatagcagaaaaaccggcttctttcgcaagcaaagcggccatcccgtcatgggcgccgggaatttgaagaatgtccggtgctgacatcagcttgcggaaacgcccggcaagctcctcttgtgacgattgcttattgacgatccacgacatgaaacaaatcccccttttacatgcagaacatgtctacgaattcatttacgcgcatcgtttgtaatgtctcatagctggtacagcgctcataaatgtgtttgtgctgtttatcaggaaaatgggttttgagattgtcagaaaacttttccagcagtttcggcactgcttcctctcttcgaaaacgatggccgaggggaaactcacattccaccatttccgtgctcgttccgtctttaaaatgaacctgaacggcatttgagatggaacgtttatcaggttttaaataatcctcggtatatgttttattttcagtcacttccattttatcacgaagtttatctattctcggatcactcgctgtttcagcttcataatgctgtgcggtgatatcaccaaaaagcaaaccgattgctgtaatgtattggagacagtgatcacggtctgccggattgtggagcgggccttttttatcaatgatacggatagcggattcatgcgttctgatgacaactcggtcaatctcgtcaatccggttctttacctgcgggtgaagaatgacggcgcactccgccgctgtctgggcgtgaaattccgcaggataagacactttaaataacacattttccatgacataagcgtcaagcggacgggcaagcttgatctctttcttattgaataaaacgtcttggaacccccaacccggtgcactcagggctgtcggataacccatttccccttttaacgacatcagcgccaaatgaacacctctgctcgttgcatctcctgccgcccatgatttacgcgagcctgtattcggtgaatggcggtatgtcctcaatgctgcattgtcaatccatgcattcgaaagcgcatttttgatttcttctcttccgccgcccaaaagctttgccgcaacagcggttgtcgcaactttgacaaacagcacatggtcaaggccaactcgatttaagctgttttctaacgccagcacaccttggatctcgtgtgctttgatcatcatctcaagtacgtcgcgtactgttaacggctcttttccttcagacagcctcactcttgatacataatcagcagcggcaaggattcctcccaagttatcggatggatgcccccactccgccgccagccacgtatcgttgtaatcgagccagcgaatcatgcagccgatattaaacgctgccctcacaggatcgagaacatatgacgttcccggcactttgcttccattcggcacagtcgttcctggaacaatcgggccaagcagctttgtgcattccggataccgtagcgccaagatcccgcagcccagggtatccagcaatacatgccccgctgttgtatacgcttcggcactagtaatctctttctcaagcacatagtctgtgatttcttcgataacacgatccgttttcggcattctaccagttcctttcatggttttgtttgatatcgcgggcccatgtaactgacgcggggacggaagagccgattattggcatgctgttcgatcacatgggcgcataaaccggacgttctcgcgctgaaaaagatcggcgtatataaaggaatcggtatgccgagcatccaatacactggggcagcatagtaatccaaattcgggtaaagccctttttccttctccatcagccgctcacccgcttcgcacatctcatataaacgatggtcaccggctttatcgcataattgctgcagcgcctctttcatcatgagtgctctcgggtccatttttttcatatacacccggtggccgaagcccatgattttttcttttcttttcagttttgtttgcaaaagctgctcaaaatcagatgtcgtttttgcctccaaaagcaaatacatcacagcttcgtttgctcctccgtgaagattccctttcagggaagcgacagccccagtcaaagccccataaagatctgaatgtgtagatgcaatgaccctggccgcaaaggttgaattcggcatctcatgctcactgtacaggacgagcgaccggtcaaaaatctgttcttccaatgaagacggcaatttccctgtcatcatgtagagaaaattcgcactgtaggatagggtttgaagcggaagaatcggttctttcttattaatgatcctgtagctggcagcagtgagggcaggcattttcccaagaagctgataggcgcgttctttgtttgcggaaggagaccgatcatcaatttgccgatcatagccagcaagtgccgacaggccggtacgcagactatccattggatgagtgtcctcagggagcagctcaagcagacggagatgatcagcaggcaggcttgaggcactgattattttacgttccagcgtctccatttcactttcttctggcagcctgccctccagcaataaatggacaagctccagatagctttttgtttcagaaagctctattaaatcatagcctcttatcaaaatctggctggactgcgtgtcaagataagaaatatgagtttctgccgcaatcacaccgtccaaccctggagaatattgctgtttctcctccatatcctcaacctccgtttttgcgttttttgtctatcaggttccgccaagcaaatacttggaaataatcagtctttgaatctcgttcgtcccttcataaatttgcgtcacctttgcatcgcgaagcaggcgctcaactggataatccttcatatagccatatcccccataaatttgaacggcgtctaacgccgcctttacggctgcatcggaagcaaattgtttagccatagacgcttcttttccacagtttaggccgcggttatgaaggtctgcagcgtggtagacaagatgtcttgccgcctcagctctagtcgccatatcagccagcttaaatgaaatggcttgattggctgcgatcggccttccaaattgcactcgctgcttcgcataatcaacggcatgctcaagagccgcctctgcaattccgagggcctgtgccgcaatgccgatccggccgacatttaaattcgccatggcaatgtgaaagccatccccctctttgccaagcaaattggcttcaggcacttctgcattatcaaaaatcagttccgtagtattggagccataaagccccagctttctttctttttttccaacggtaaaaccgggtgtgtttttttcaacaataaaagccgaaatcccgtgcctgccttgatctggagctgttaaagcaaatgtgatatagatatcagctgctccgccattcgttatgaatattttcgatccgtttaatagatatttgccgttctttttgattgctgttgtgcggaggctcccggcatccgaccccgagtgaggctccgttagtgcaaatgcgcccaaatggtctcctgacgcgagctttggtatatatttcatcttctgttcttcgttgccgaagtacagaatcggattcgtgccgactgaggtatgaacggagagaatcacgccgacagccgcgctgattctagaaatctcatgaatcgccaaaatataagaaacaacgtctgccccgacaccgccgtactgttccggcaccggtattcccatcaggccgtgttcgcccatttttttgatcagctgaaagggaaattcgtccgttttctccatgatttccgcagcgggagcaatttcttttcgtgcaaaatcacgcaccatttttcgcatcatgacttgctcttgggttacatgcaactcggccacccccggatggaatagacttcaggaagtcctctcctcatagtcataaaaaccgcgtccgctctttttgccaagccagcctgctttgacatacttgcggagcagcgggcatggacggtatttggaatcgccaaggcctgagtgaaggacttccataattgataaacacgtatccagtccgataaaatccgctaatgcaagcggacccatcggatgattcatgcccagcttcatcacttcatctattgcctccggcttcgccactccctcatacacgcaatagatggcttcattaatcattggaagaagcacacggttggaaacaaacccaggaaaatcattgacttctaccgctgttttccccatcttttccgctaatgccataacatctaaggccgtttcttctgatgtagccaagcctcgaatcacttctaccagcttcattacagggacgggattcataaaatgcatgccaataacccgttgaggccggtttgttacagcagcgatttctgtaataggcaaggaagatgtattgctggccaaaatcgtatgaggcgggcaaatgcgatcaagtgttttaaacatctcagtttttgccgccatgttttctgcgatagcctcaatcacaatgtccgcatgctctgcctcctcaagcgtttgagaaatcgaaatgcggttgattacgctcttcacttccgtctcggtcctttttcctttctcagcatcacgggccagctgtttcttcagccgtttcaatcctgcctccgcggcctctggattcacatcatacatccgcacataaaagcccgcgccggcagctgtttgagcaattccgcttcccatctgacctgcgccagctaccatgatttgtttgatttccattcaaatcccctttttcatcatgttttaatgaacctgcactaagacggcgtctccctgtgctgccccgctgcaaatagcggcaacgcccagaccccctccccggcgctttaattcataaacaagcgtcatgagaattctcgccccgctcgcgccgatcgggtggccgagcgcgatcgcaccgccattcacatttactttttcaagatcgaaacctacgattttttcacatgtcaaaacaactgaagcaaaagcttcatttacttcaaacaagtcaatatcttggacagttaaaccattctttttcaggagcttgttaatagcaaaccccggcgctgccgccagctcgtgcgctggcattcccgtagttgaaaaaccaagaattgtagccagaggccgtttgccaagctcagcagctttttcctcagacatcagcacgaacgcgccggctccgtcattgactccaggagcattgccggctgtgatagaaccgtcacttgcataaatcggagcaagttttgcgagctgatccagacttgtgtcacggcgaatcgcttcatctttatcaacaacgtttggttttccttttcgaccgatccagttgacgggaacaatttcatcctgaaacttcccttcatcggcggccttagctgcccttgcatgacttctcaacgcccattcgtcctgctctcttcgtgagattgcatattccttggcagctgtatttccgtgaacagccatgtgcacctcgtcaaatgcgcacgttaatccgtcatacaccattaagtccctaagctcgccgtcccccatccgtgctccccagcgcccggcgggaacggcatacggaatattgctcatgctttccatcccccccgcaacaagtatgtccgcatcctgcgcccgaatcatttgatcacataaagtgacagcgcgaaggccggaagcacagactttattcagtgtttctgacggcacactccaaggcattcccgccagacgggcagcttgacgggaaggtatctgccctgagccggcctggacaaccatgcccatgacgtttccttctacatcatctccagagactccagcccgttgcagcgcctccttcatcacaatgcccccaagctcagcagctttcacctctttcaatactccgccgaatttgccaaatggcgttcttgcagcacttacaatgactgttttcctcatggtttcacctcattcagaagatagacagcgcttacaatttctagttgtcttctatgaatgtatgctttgaaacgggcatgaatgaatgaaaaaagaaggctgcgtcaaacagcctccttctaacaactattcatttttcagcaatgccgaagccttttctggaaagtcggtaaacatgccgtctgctcccgcttcaatgagacgcttcatatcttccggacgattgactgtatacggccttaccttaatcaaaccgttcctcattttcttcagtacttcatctgtgacccctgggctgtttaacttcgggtgatagccggaagccggaatagacgcgatatatcgatctgcctgataaagcacatctgaagttaatactgcccgttcgatatgcggtgcaagccgggcgcacagcgccaagctgtcatgattaaacgtggataggatgactctgtcctctacattaaatcgcttcactgcctccagcactttttcttccattccctcatagcggatcacgctgttttttaattcaatgttgatgagaaaatccttttttaccgcccacgagagcacatcttctagcagcggcacttttatatcgctgtacgcttgatcgtgaccagcggccgcatttgcagtctttacctcatcataggctgtatccttcacgaatcctttaagtgatgtcgtgcgattaagtctttcatcatgaattacaacaatgcgtccgtctttcgtcagctgtacatcaagctctatcccatccgctccggcttcaattcctttttcaaatgcaagcattgtattttcgggaaattgacctgatgccccccgatgggcaaaaatctttgtcatcgtttcacctcaaaccctaaagttttctccattatacttattttgtcggctccactctaggattaaggctgtatcaatctactgatcataataagaatcaatgccgttgacaatcgcatctgcggccttttgctggtattcttcacttcccagcttgtccgcgtcagagctgttcgtgataaacccaagctccgccaacacacttggcatttgtgaatatgtaatgacgtaaaagtctgattctttcacgcccctgtctctcgtttgtaaggaagaaacgagctctgactgaatatcggatgcgagacgccggctgttctccccttcataatcagattgaaaatacgtttctgttcctgaagctgaagcaacccctgaattcacatgaatgctgacaaaaaggtcagcctgattggcacttgccttagccactctttcctccaaggtcagaaaatgatcgtcagaccgggatgcaacaggattggctacctcctcttttagtttgtctgtcacatgctctgagacagccaaattaatatccttttcaaagagcccgtttccgaccgctccactatcttcaccgccgtgtccggcatcaatatacactgttttcccttctatcggctctgctgcctgtgcacaaggcgcgagcgtcaaagccaatccgcacagcgccaagctcctccataacattctcaacttactccctccggtcacgagttctttcgcagctgaatatcttccagctgtaaagttccattatccttctttgtatatttcaccaggacatgtgtctgatctggcagtgattcacattcatcacgtttatccttcggaacttgtatcatggtttcttctccattaagagaaaccgcaatcgtatgaggatcagccgagccaatgtattttccctcttcggtaaaccttggcactgagtcatccgcacttgcaacactgcaccccgaaagaaagagcgcagtaaacagcaaaagaaccgtttgtttcacatgaccacctcttcctgatgtttggcttttatctttgaccagaatggcgaatttgtaaagacaacgcgaatgcaggcgagcaagttccatgattttcaaaagggctatacgacccgatcatttcctgttgttagaaagataacgagcagatttgtctatgaggatggctctaattgaggcgtcaattagaaaaaattagcggaaagaagcaactttttattcattttaaaaaatttgagaatagggtgagcaaatcgtttgacgggtgggtcagccaagcgtaaccttttaaaggatatttactttattgaaagaagttaaaaccatgaaaaaattcgttctgctgctggcggcagctgtcatcacatgctccatcggccaccaaatcagcggcggctacaaaggccccgaaaaagagcggcgaaaacatcactctgcactcaagatattcagtcggtaaagcagatcaattgcattaatttttacatataggctagaatatgtgcgaatccaaacgaaagaagatgatcaaatgaatcctaagtataagccactttttgaaccatttacgtttaaaagcggcgttacaatcaacaaccggatcgcagtagcaccgatgactcattacgcttctaatgaagacggtacaatatctgaagcggagctcgactacatcatcccccgttcaaaagagatgggaatggtgattacagcctgcgcaaatgttacaccggacggaaaagcattccccgggcagccggccatccatgacgattccaacattccaggtttaaaaaagttagcacaagccattcaggcacaaggcgctaaagctgttgtacaaattcatcacggcggtattgagtgcccgtctgagctcgttcctcaacaggatgttgtggggccaagtgacgtgtttgataacggcaaacaaattgctcgcgcattaacagaagaagaagtggaaaacattgtgaaggcgtttggagaagcgacaagacgcgccattgaagtcggctttgacggtgtcgaaattcacggtgcaaacggctacttaattcagcagttttattctccgaaaaccaaccagcgcacggatcgctggggaggaagcgatgaaaaacgattagccttcccgctcgctattgtcgatgaagtgaaaaaagccgcttcagaacatgcgaagggtgcgttcttagtcggctaccgcctgtctccggaagaacctgagacaccgggattgacaatgactgaaacttatacgcttgttgatgctttaggggataaagaattggattatcttcatatctcactgatggacgtgaactcaaaagcgcgccgcggtgcagatccgactcgcacacgcatggacttattgaatgaacgtgtcggaaacaaagtgccgctgatcgccgtcggttccatccattccgctgatgacgcgcttgccgtcatcgaaaacggtattccgctggtcgctatgggacgcgaaattctagttgaccctaactggacggtaaaagtaaaagaaggccgtgaaaagcaaatcgaaacagtgatcaaaggcacagataaagaaaaatatcatttgcctgaaccgctatggcaagcaattgtgaacacacaaggctgggtgccttataaagattaatgtgcaaagactgccgaaacgattcggcagtcttttttccctttatataaatagtttgtgtacacatctaaacagcaaaagaaagagctccccaccaacttcgaaaagaaaatccaggaaaaacccctcacgctttcttgcttttttctttttcattcgtacgtctcctttttacatgaatacgccttacttacgattttgcaggagaaaggtttcattttataacggacacatctagggtcgatcatgcttcgtgatcctataagatgtatgaatggaccaagagtgcaggtaataccgccatttgctttccttacttttcaaacctatcctttactatatgcggatacttaatattcttctcccatactaacaaatgtccccaaaacaaaacgcctcctatttatcagcgcaaactaataaataaaagacgtttgatttaatgaccacttaataagctcatgtttaagaagccttatgttctaatctcagcttatccgcaaccattgcaatgaattccgaatttgtcggtttagcttttgtcatgctgacagtataaccgaacaacgaggaaatggaatcaatgtttcctctgctccatgccacttcaattgcatggcggatcgctctttctacacggcttgcggttgtgttgaattttttggcgatgtccggatagaggacttttgtaatgctgccgagcaattcgatgtcattgtataccattgagattgcttcgcgcagatagagatagcctttaatatgggctgggacgccgatttcatggataatgcttgtgatgctcgcgtcgagatttttcttctttggttcaggctggctgctgcgtataatactgctttgcgatgatggcgcacgatgcgtcacactgctggcatttccgctgacctggcggatatggccgacaaggttttccatatcaaacggtttgagaataaagtaggacgcgcctaaatcgacggcctttttcgtgacatcttcctgtccaaaggctgtcagcataatgacattcggctgttttttcagatctgattccctcagcctctctaaaaccgcaagtccgtctaaatgcggcataataatatctaatacgagcacatcgggatctttttctttaaacagcgacaggcattcctgtccgttataagcaacgccgatcacttccatgtcttcctgtccttctatatattcacttaacaggcttaccagctctcgattatcatcagcaacacaaactttaattttctccacgtttcttcctccccaaatgtagttaacaggattcacccttgctacatgtttacattcgacaaaaccgctatataccctctaaaaaaatcataatcaccaatattagtggcatatctttgttattctatgtttttctctgtttttcgactaaaaatgaaatttgacaaacaaggaaacgtgaatttgtcgaaaaatcttcttttgtatattttaccgtatgtattctgagaagtgaagagggatcaaaataaaaaaactgccggaaactccggcagtcagcttgctttttcttttccataaatatcgattcctgcttctgacagcatccattcaatatgaacaccgtagccgcttgtcgggtcatttacaaatacatgggtgacagcaccgatcacttttccattttgaatgatcgggcttccgctcatcccctgtacgatgcctcctgtttctttcaacagtcttggatcggtaattttcaacaccattccttttgtcgcagggaatttttgcggcgttgtgctgacgatttcaatatcgaatttttctactttgtcatcatcaataacggttaaaatttcagccggcccttttttgacttcggtagaaaacgcaaccggcaatgcttgatctgatatgttgttttgaatcggctgatgcagtgtgccgaaaatcccaaacgggctgtttctgttaatatccccgatcgttttgcgttctgaggaaaatcgcgccagtttttctcccggattaccgcctgtccctttttcaattgatgttacagtggatttaacgatttctccattctccactacaattggtttctttgtgtccatatcggaaatcacgtggccaagtgctccgtatttttttgttttcggttcataaaaggtcatagtgccgatgccggcagcagaatctctgatatataacccgattctgtatttgccttctccttcatccttttctgggatcagcttcgttttgattttctgtttatcacgtttgatcagtaagtctaaagattcaccagttttcccagccttttgaataaatggggctacatcattcattttttcaattttctgtccattcatctcaataatgatgtcgcccgcctcaattcctgccgtttctcccggagattttttgccttcacttgtattgatttgatgaaatccgacgacaagaacaccgacggaatgaagttttacaccgattgattgtccgccaggtataacttttaaatcaggaagaacatgcacttttgtttttttaattggaaatccggcaagatcatataccaattctgactcacctgattttttgcccgtcaccttgatttcatgcggatctttctttactgtaaacgcttctgaggattctgatgtctgagcgtttaccgataaactcgtttcaatcgcttgtgtttgggtttcaaatactctcatttgcgttggaatcagtaaatattcttttagcggtttgcataaacctacacttaataacgaaacaaggagaattaaacctactgcttttctgatgttatcgggcattcactacttcactctcctcgctcctatcccacaccttctttatgacttgctgctacatcatttaattttgccttctgacggcttatttataactgtcatatgaagaaaaacattggatatactgatgaacgaatggatgtgcacgaaaaaaataagctgcgcttctcgcgcagcttacccagttgttttgacttgatccgcttgttttaaaagttctttcgcatggcgtttcgttaaatcggttacctcgacacctgcaatcatgcgcccgatttccgctaccttttcctgcttagacagcggcttgacacgtgtcgtcgttctaccgtcttttaactccttcgcaatataaagatgcgtatcggccatggcagccacctgaggcaggtgtgtaatgcacagcacttgtgaacctattgacaccttatggatcttctcagcgattgcctgtgcgaccctgccgcttacaccggtatcaacctcatcaaaaatgatcgatgtcacatcctgttgtgaggagaaaatgctttttatggcaagcatcacccgtgacagctctccacctgaagcgactttcgaaagggattttagcggctcgcctgtattggttgaaattaaaaacttcaccaggtcaatcccttgttcagtcagctgaacgggctggccgtttacaagcggcgcctcttcattgcgtgacgctgttctgaccttaaattccgtatcaaaagttgatttttccatgtacaggctttttaattcccgatgaatctcatcagccagctttttcgcccatgtttttcggatttgtgacacatttgccgcttccactgcgacatctttgccgacggagtcaagctcctttttcaagctttgaaggtggctgtccctgttttcaatttggtcaatctcttcttcaattttagaagcatattccaaaatgtcttcaacagtggcaccgtattttcgtttcagctgtttgatttcattaagtcgcgtctcaatatagttcaggcgttccggatcaaattcaagctcatccagcatatttctcatctgaaatgtggcatcctcaagcaaatagtaggagttcgaaacactttcagacatttttttcagcggttcgtttatatcagatatatcttcaagctgcgctgatgccattccaacccagtccaatccgccctgctcactgcgaagcgcgttatatgcattttgcagcgactcatatatcttctcaaagtttgaaatttgctggcgctcttcttggagctgttcatcttcgttaagctcaagctttgccgattcgatttcttcgagctgaaattgaataagatcaagacgatgggccatttcctgttcgctttcagaaagctgcttaagctttttgagcagcttcacataccgctggtacccttcctgatacgttttgagcgcgctttccacttcggccccggcaaacttgtccaaaagctggagatgattttcgtcttccattaacagctggttatcgtgctgcccgtgaatatctaataaaagcctgccgatctctcttagtgaagcaatcgtgacaagcttgccattgacacggcaaacgcttttcccgctcgtgctgatatcccttctcatgacgatcatttcgtctgaaacgtcgattccctgctcagcgcatacgcctaaaacaggatggccgctctccaacagaaacagcccttcaagttcggcttttgcttccccatatctaacaaattcagatgatccgcggcctccgactaaaagagaaatggcatctatgatgatggatttgccggctccggtttctcctgttaaaaccgtaagcccgcgttcaaaagaaaccgtcagttcctcaataatggcaaagtttttaatcgatagttcagctaacaaacagcattacacctcttatctttgttagattttctgttacagcagttcaaggagcctgttttttacgccttctgtatcttcaggagtccggcaaataattaaaatcgtatcatctccgcaaatggtccccatcatttcatcccagtccaaattgtccatcagcgccccgattgcctgggcattgcccggcatcgttttcagcacaatcatatggcttgctgagtctattttcacaaatgcgtccatcaatgcccgctttagctttgacagcggattgaaacgctggtccgccggaagactgtatttgtaagaaccattatttgtaggcacttttacaaggtgaagttctttaatatcccgtgataccgtggcctgcgttactttgtatccatcctgctttagcatgtcgaccaattcatcctgtgtttcgatttcattgcttgtaatgatctctctgattttaatatgcctctggcctttgttcatgtaagcacctctatttccaagcttatctgttcttttatgttatatgattctctgcacattgtacatgaatgcagaaaaaaggaataatagcgccctattattccggtacatctgcttttttttcttttaacgtcttatgtgcttcttctacaacgcgcatgatctcttcttccggcagttcctggccttcctgtccctctcccggccaatgcaaatgaaggagaaactcaatatttccgtctcctcccgtgattggagaaaatgacaagcctttacagatatagccttcagcggcagaaaaactgatcattcgcttgagcacatcagcatgcactttaggatctctaacaatcccttttttgccgacggattcccgtcccgcttcaaactgaggcttaactaaagccatgcagtcgctgcccggtacgagcaaagtccttaggacaggcaggatgagccgcagtgaaataaaggacacatcaattgtggcaaactccggcatgccctttgtaaagtctgccggtgttgcataacgaaagttcgtccgttccatcacgacgacccgttcatcctgtctaagcttccatgcaagctgattatagcctacatccacagcgtatgactgtttagctccattttgcaaagcgcagtccgtaaaaccgccggtggaggagccaatatcaatcataattttatctttgacagagacgggaaattccttcaacgctttttcgagctttaagccgcccctgctcacatacctcagcgggtttcctttgacagttaacggaaggtcgcggtcaattttttctccaggcttgtccaagcggttttcgtttgaatagacgatccccgccataatggctcttttggctttttcacgcgtttccgccagccctctttccactaataatacatctaatcgttctttctttgacgtcatgatccaattcctttgtgtgtctttggcggcatcagtaatctaatacgatttgccacctgctgttttgtcagtccaatttcctcaagaagcgctgttacacttccgtgttcaataaaccgatcaggtatacccattctgtcaatcggagtatgatattcaccttgatcatgagcgaattctaaaatcgagcttccgaaaccgccttctaagaccgcttcttcaattgttaaaattggcaagccttcttttaggatactcttcatcatcttttcatcaatcggcttaataaaacgcgcattcacaacgcgcacggaaaggccttctttctgcagctcttcggctgcttcaatcgccatttcgattgttgtgccgaatgttaagatgacagcatcgttccccggacgcagcacctcccacgtaccgatcggaatcgttttcaactgttcatccatttttacgccgagtccgtttccgcgcggaaaacgcatcgctatcgggccttcgtcatagctaagtgctgtatgaaccatatgctggccttcattttcgtctttcggcatcattaagaccatgtttggaatgtggcgcataaacgcaatatcaaacacgccttgatgtgtctctccatcagcgccaacgagtcctgcacggtcaattccaataaacacattggcgttttggcggcagatgtcatggacaacttggtcatatgccctttgcaggaaggttgagtaaatcgccaaaaacggcttcataccctgcattgccatagctgccgccatcgttgcggcatgctgttctgcgattcctacgtcgaacatccggtcagggaattcctttgcgaaaccttcaagctttgaaccgacaggcatagccggcgtaatggctacaatgcgtccgtcctcgcgcgccattcgctgcacagttccgctgacaagaccgctccacgaaggagctgcggctttcggctttacaaagtcaccggtattaattttatatggtccggtaccatgccatgtcccaatcgtatcggtctcagccggtttgtaccccttcccttttttcgtgatgacatgcagaagaacagggcctttcgtttttttggcgtattgaagattctcaatcagctcatgataagaatgtccgtccactggacccaaatacgtaaaaccgagctcctcgaaaaacattccggagacgagcatgtatttcaggctgtctttgactcgttccgccgtggcggcaagcttgcccccaactgccggaatctttttaaataagtattcaagctcatctttgacccactggtatttccccgcagtacggagccgtccgagcatagagtgaatggcaccgacatttggtgcaatactcatttcattatcattaaggatgacaatcatgtcttttttctcgtcgccgatgtggttaagggcttcgagcgccattccgccggtcagcgcgccgtcaccaattatcggaataatatattcatccgttcctttaatatcacgggcagctgccattcccatcgcgcctgacagagaagtcgagctgtgcccggtttcccaaacatcgtgctcgctttcactccgctttggaaatccgcaaagccctttgtactggcgaagcgtcgcgaattcttttcctcgtcctgtcagcagcttatggacatacgattgatggcctacatcccataaaaatttgtctttcgggctgttaaattccttatgcagagcaatagtaagctctacgacacctaagtttgggccgatgtggccgccggaagcggataaacttgtaattaaaaactgacggatttcatcacttaatttctctaattcatcaatggacatgttttttaaaaacgacgggtcctgtattgataaaagatccaaagcggatcaactcactttcagcatgaatttctgcaatgatacatgtcttttgcatgccgagctgacaataatctcagacataaaaaaagacaaacgcgcttttccttttcatttttcatataaactgcttacattttaccatacctcgtgcagccgcttcaaattaggatcgttttagtgatctcttgccgcaattaaatcacaaagctcatataaaaggtctttttgaagagagagtccgccgatcaatcgcttcgcctcttttatatgaacatccaatttatgtttggccccttccaatgaaagaagcgacgggtatgtcgatttgtcatttgtggtatccgagccgacacgtttgccgattttctcttcactgccttctaaatctaaaatatcgtctctgatttgaaatccgattccaatgtggctgctgaaggtacgcagtgtttcaatgtcttcctcaggcgcatcagccaaaatagcaccggcgattacacaaaagccaaggagcttggcagttttccgttcatgaatggattcgagctcttcaagcgtgacttgtcggttttccgcttccatatcagctacttgcccaccgaccatgccttcggtgcctgccgctgaaatcagttcattcacaagccgcaggcgcttttctgctgacacctcgtctgacacgtgggaggtaatcagcttaaagctttctgtgagcagcccgtcacccgctaatactgccgtcgcttcaccaaacactttatggtttgtcggcttcccgcggcgcaaatcgtcatcatccatgcatggaagatcatcatgaattaacgaatacgtgtgaatcatttcgacagcacagcccaccggaatgccgtctttttcgctttttccatatgcatttaaaacagccagtacaatcagaggccgcagccgctttccgccggcctgtagagaatacagcatagatttctttaatgagtccggcatatcaagcttttctgtatagacagaaagctgattttcaattgtttttttccggtccgccagaaagctcgttaatttatttgtcaccttcgtcttcctcctgaacactgaaaggtgccagttcgccgtcttcttttaaaatgaagtccatttgcttttcgactttttgcagcttttcatggcacatttttgacagagccatgccttcttggaaatagttaatggcttgctctagaggcacatctccctcttcaagctttgatacaatgctctcaagccctttcatcgcttcttcaaatgtcatgttttcattttttttcacgtctgtcatttttcttcccctctcttttctaatacttcacaggtcagcacgccatccttcagcttgacttcaagccggtcctgctcttctatttgactgacacttttaatgagtttatcttctttataagccaagctgtatcctctttccatcacttgaagaggacttagtgcattcagcttgccaagaacggtttgaaattgggaatgcagctgcttcatttggatattcatattttttctcagctgatttgtttgttcctggtatcgtgttctcgcttgtttcagctgttcatgaggatgcagtgcctctaatctgtacgtttcacgctccagctgtctgcttttccgatctaaaagagcggtcagctgtgcttgaaactgctggtacgcgaggtcaaactgctgctctttttgcgcatacaaacgctttggaaaacgaaaggcataggacgattgcagcgtttgaatccgttcttttttctggccgaggtgctgctgcatcgctcttgtcattctgacttccgctgtttttgtccgttcgattaaatcagtggtatgaggcacagcaatctcagctgctcctgtcggcgtcgcagctctgatatcggcgacaaaatcactaatcgtaaaatccgtctcatgtccgactgccgatataatcggaatattggaagcaaagatggcgcgtgctacaatttcttcattgaatgcccacagttcttctatcgaaccgccgcctctcccgacaattaatacgtcgcaaatctctttttcatttgcctcttcaatgcgcgtaacgatggatctgctcgcattttcaccttgtacgagcgctggaagaacaatgacttttacaaggggatatcttctttttagagttgtaataacgtctctgacagcggcacccgttggagatgtcacaaccccgattgtggctggaaatgcggggatttgttttttgtagcggtcgtcaaataaaccttctccggcaagcttcttttttaattcttcgtacgctaaataaagcgctccaatcccgtcaggctgcatttctttggcatataattgatagtttccgctcggttcatatacggaaattccgcctctgaccagcactttcattccgttttcaggtttaaaaggcagacgctcgctttgtctcgcgaacatcaccgactgcattcttgcgttttcgtcttttaaagtgaaataaatatgccctcgtgtgtgtatctttacattcgacaattcgcctttaatccaaatattttcaaggtgaggatctacatcgaattttcgttttatatactttgtcagcgctgagacggtcacatacgctgcttcacccatgtctaaaaactcctctcctaagcattcctgcaccataactaaagaaaacccgccctggctttaggagcctgaagaagcgggtatcgtgctcatattcaaggcgggcaaacatttcgcctgtgaatatctccaattatctatgataacgtacgtttcgcagatttaacagtattatgcgcaagcatcgtgatggtcatcggacctactccgcccggaaccggcgtgatgaaggacgctttttcctttgccccttcaaattcaacgtctccgcaaagctttccgttttccagacggttaacgccgacgtcaatgacaacagcgccctctttgatctggtctgcactgatgaagttggctctgccgactgccaccaccaggatgtccgcttttttcgtatgttcagtaatattttctgttcttgaatgacagtaagtaaccgtcgcgttttcatttaataaaagctggccgacaggtttgccgacaatgttgcttcggccgactacaacaacctctttaccggaaaggtcaatattggttttcttcaaaagctcaacaattccatgaggcgtgcaaggaagaaacgtatcttcgccaagcagcattttccctacgtttaacggatgaaaaccgtctacatctttatcaggggagatacgttcgatcaccgctttttcagaaatatggtctgggagcggaagctgaacgagaatgccatgaaactcagggtcttggttatattgatcaataatggaaagcagttcagcttctgtgaggctgctgtcaaattgatcgagcttgaaattcattcccattgtttctgccgcttttttctttcctcgcacgtaagagtgagaagcaggatcatctccaatcaaaataaccgccagtccgggagtgacgccttgctttttaagctcttctacctcttttgccaattgttcgcgtttttctctagccgtttcttttccgtcgatgattgttgcagtcattttctttcctcctatgattgttcaatatcagatttaatgttagaaagaaccccgtttacaaactttgtcgctttgtcatcaccaaaccgttttgccagctcaatcgcttcgttcatggagacattcaccggaatgtcttcggcatatgccatttcatatgctgccaggcgcaaaatcgcacggtcaacattggcaatccgatcgagcttccaattcaccagatgcttggagatcatttcatccagctggtcttggtgttccaataccccgtgtacaagctgttcaaagaaaggatctgttttttcttcatccagtgcgtgttctatggcttcattcactgcaatatcgctgacatcaatttgaaatagtgcctgcaaagctttttctcttgctgttcttcttttcattttctttctcctttgatcctctttatccgcttgtcgttaagccacaaagagatcataacatatttttttcgtatccgcatattgaaatcaaggtttttttaccctattaccgaatattttcacacaccttaatatgattattcggatttcacgttcatgaagaaactcggctatgtaagccggctttcttcatgctttgaaataaagggtaacgtgtaaaaaaaccaaagggccgccctccccttggtttcgtgttaagccatttacatttcttcgtcgatttggacttcttgggcttttgtgtcaaattgaatgccgacgatgtgaatattgatctcgttaatcgaaagagacgtcatatttaataaggtttgacgaatgttttcctgaacggatgctgcaactttcggaatcgaaacgccaaatgtaacgacacagtatacatcgatcgtaattccgtcatccgccaggtcgactttgacacctttgccatgattcactttgccaaagcgctcaacgacgcctgtcgcaaagtttccgcgcatttcggcaactccatcaacttctgatgctgcaatgccggcaatgacctcaatgacctccggtgcaatctcaaccttacccaaatgcgtatcttcgtgatccattttaagcaagctgttgtctttcattcaattcacctccgtaaaaattatgagcccattacatcatatgtttctaaaaatttcgtattaaactctccgctcacaaatgtttcgtgttcaagcagttttaaatggaaagggattgttgtctcaatgccttcgatgacgaattcgctcaatgcgcgcttcatgcgggcaatcgcttcatccctcgtttttccgtatgtgattacctttgcaatcatgctgtcatagtacggtgggatggaatagccagggtacgcagctgaatcgacacggacaccaagaccgccaggaggcaggtacattttaatttcaccaggtgacggcatgaaatttttacttgggttttctgcgttgattcggcattcgatggcccagccttcaaattcaacatcttcttgcttgaggctcagttccattcctgatgccactttgatttgttccttgatcaggtcagttcccgtcaccatttctgtgactgggtgctccacctgaattctcgtgttcatttccatgaagtaatagcgctgttcattgtagtcatagataaattcaactgttccagcacctgtatagccaaccgcttttgcagcctttaccgctgcatctcccatttgctccctgatttctgaatcaagggcaggagatggtgattcttccaaaagcttttgcaggcgtctttggatcgagcagtcgcgttcgcccaaatggatcgtatttccgtagttatcagcaagcacttggatctcaacgtggcgaaaatcttctatgtatttttcgatgtatacacctggattcccaaatgcagttgccgcttcctgctgtgtaatcttaatgccattaatcagttcctcttcagtgcgggcaaccctaattccttttccgcctccgcctgcggtggcttttataattacaggatacccaatttcattagcaagcgaaaccgcttcttccacattttctataattccctgtgaacccggtacgattggcacgccggcctgtttcatcgtttcccgcgcaacgtcttttgttcccatttttgaaatggcgtcagcgctcgggccgacaaacgtgacattcacttcttcacataattcagcgaaatcagcattttcagctaaaaatccgtatcccggatgaatggcgtccgtgccagtcagctttgcaacactcacaatatttgtaacgtttaaatagctgtcttttgatgctttcggtccgatacaaaaagcttcatcggccatttgaacatgaagggcatctttatcagcttctgaataaacagcgacagtctcaattccgagctctctgcaggctctgatgattctgacagcaatttctcctctgttggcgatcaatagctttttaatcatgttcagtctccttactccgcttttacaagaaatagaggttgtccgtattcgaccagctggccgttttctactaatacttcaacgatttcgcctttcacttctgcttcgatttcgttgaaaagcttcatcgcttctacaatgcagacaactgtgttttcatttacttttgaaccggctgttacatacgggccagcttccggtgatgaagaagcataaaatgttcctaccattggtgaagtgattttatgcagattctcatcttgctttggtgcttcttgggcaggtgccgctgcttgctgcgcttgcggctgaactgcctgcggagcctgtgcttgtacaggtgctgccggtgcctgctgcatgacttgaaccgtgcctgcttcgtgttttttcagttttaaggatacaccttcattttcatatacgaattcgtcaattgtagactcgtcaattgctttaatcagctcgtggatttctttgatatttaacattcaatcgcactcctatgtatgaaatttctttttttataggttactgctaaaagtacatactatgttcatcttacaggagcggacttttgaattcaactctaatatgacagcaacgcaaaaagcccgcttgtttagcgggcttttttccctcattcttatttagagggttcaaatgtgacagcgacatctttcattgttttgatttcttttgccacaaggtctataatggctgtcgccttcgatttagagtgtttgtctgatttgactgtaatattgattttatctccttcagcattaacaagcgcatcctcgtaaccttgtgttttaatcagcgtttccagctgtttttctgttccttccacttcactgagagccgtcattttatcgtatgcttcgcttttctccttggctgttgcatcatcgcttgacacaatggcattcagctcttctctttctttgcttctggcatcttctaaatcaagacggtacgttgtaaacaaatcatcatcggctgtttccgtaacaacagttcctttttcactggcttcagcggatgtttccttgtctgctgatgaatctttcgttccctttgttccatcttcttttcctttttcagtttctgtaccgcttttttccttcgtgtcttgcttggcaggcgctttttcagttgcgacctctccgctgtcagacgcgcttttttcactttgcatctgcacggcgtttttgctttccggcgacatgatatagtagacgcttaacaccacgacaagactgagcattgttaatagccaaacggtttgttttttaagcatttatgaatcctcctttatttttttaggggcaaccgcaacccggtggcttggaacatccaggacccgtgtcaccgcttcgataatggtttgttttatttgaacgttgtccactccttgagcaacaacgagtacaccgcgtatatcaggttttttcgtttggacgacgacaggtgtttctttatcgccgtttttgatcatgacgatttcttcctccgatgtttggtctgtaacgcttcttgttccgccttctttgtcagtttcttcggtggttgtatttttgtttgatttgtttttttcgtatactttcagcgacgttgcatctacattcacgacaaccgagacatcgtccacaccaatgattgtttcaagaatttctttcagctgattttcgtattctttttcatagtcatcgatcgagtctttaggtttatcagattttgaggctttaaacacttcagctgttttctctttgctgcccgcggaatgttgcgatgatacggccgttatcgttttggcgttttctgttttctcaggtgaagaaaacagctggctgacaagcataaaggaaactccgagaacaaaaacgaatagaaagtaatgatatttggtcagcttcggcttttcgccgtccttcgtttgtcccggaagaaactgctttttcaatacattccataatccgtttttattcattgccgacactctccccgccttccatatgaaccgtaattttctcacttccgatttcccaaatgtccgcgagctgcgtttgtatctgtttggcttctttttgttcggctgcttctttcgttacgtatgcatgatctgtatcaatgtggaccggcgcgaccgtttggaccgttttttcagaagacggggccatatacacgctgattgttttaatatcctcttctgaatctaccttttctcctgccgtgagtttgatgcggcctactttatattcatcatgactgaatctctcctccgctttcttttttagttggacagccatttcttctagaatatatgcgcgctgggaagcttgtatttctattttttttgaattgatttgattttttatgtcggcagactctgactgcccgttttttgtgagatattcaaagatgatttcggggtctgtcttgaaaagtttaaaaatcggcgtaagcatgacgacaatcaagagcaggctgactaccatttttgcgtacttttgcatgctggagctcggcagcagcatatcaatcacaattgcaaataggataaacaacacgatggtggtaagccattccgttaaaaaactcattcgcctgcctccttcatttcatcatcatcgtgaggtttccggctgtgattatgacagtaaggcttaaaaaaaacatgagagacacaatagcgagagctgcaaaaatataaatgacgcttttgctgatgacgtcgaggcaggtgatgacgggcccgcctcctagcggctgaagaatcgcggctgccagcttataaataaaagcgagggaaagcactttgattgccggaaatgccgcgatacagatcaaaatagcaacaccgagaatccctaccgtatttttcagcagtaaagaggcgctgattactgtatctgttgcgtctgtaaacattcggccaagcacaggaataaaatttccggttataaatttagccgtcctgagcgtaatgccgtctgtcactgcagctgaggctccctgaacagagatgacgccgagaaagatggtaagaaaaacagccagcgctccgatagcgatatttctgagcaggttagccagctgcgttactttgtattgttcggtcatggtgctgacaatgctcagaatcgctgataagaaaatcagcggcatgacgatattctgaatcaagagaccgctcgtgttcatcaggaagaggataacaggatgaaagaaggcagcagatacagctccgcctgaggaagccaaaagcgccaagaggagcggaatgagcgccaggataaagctggtcatcgtctgaatcgcctcagttgcatagttaattgccacatgaaagctattaagcgcaaggataatcagcaccatgtacacaattgagtaagcgaccttactgacggtgctttgctgaaaagcattttgcagaagctgcagaatgacgcaaaaaatcgtgagcaaaatcaatgtgcccagcagctttccgttggcaagcacttcatgaaacaaataagaaaagagagctttcagccattcttgcggtgagaatgatttatcgccattgataaactccattaagctgcctttttggctttccggcagcagtccgccgtattctgtcataatgtcattccaaaattccccgatcttatctgtttcaagcgaggctgctgtcctttccgctaattgctcagctgtttcagcatggtcttccgtttgttctgcattaccagctgcttgtacaatttctgcacggcctgctatgatcagcacggccaaaagcaaaacccattgaaagcgcttcaatctaccgcctcctttcggttatgacatagaaggtataagtccgagaatcgtttcgataatgacggttaaaataggcacagccataacgagaattaaaatttttcccgccaattctattttcgaggcgatggccccttggccggcatcttttgtgagctgcgccccgaattcagcaatataggcgattccgataatctttaaaatggtttcaacatagaccatgttgacatttgcattaatcgcaattttttctatcattcgaataatgtcgtagatttggtctactaaataaagaaaaatggcacatccggcaaaaacgacgattaaaaacgcaaaagtcggcttttgttcttttacaattaaagaaaggaaggtggcgatcagccctaaacctacaatttgaacaatgtcaatctgcaagcccccctatccttggaataaaaacacagcttttatctttttaaataggtcatctacaatcgtggcgaccataaataaaatatagataaaacctaacagcgtcacccactgagcgtattctttcttgcccatctgatccaatatcgtgtgtaaaaaagcgaccacgattcctactccggcaatttgaaatatgacattcacgtctactcccattttatttttgctcccctcacgtttacatcaatagaagaatgagtaacaagcccgctaaaaagcccaaactttttatcattttttcatttttcgcttgcgcctgctcagcatccgcttcagaggcttccaaatgtgtcagcgccagcttgatgtgcttttgctgagagattcgatcatgaatcccgagcgtctcgccaaactgcttcagcacttcgtattcgctttttttcaaagacagggtgtcccataccttctttaagctttgctcccacgccgttttcgcggaatcacttcccttgtccagctgatcactgaatgcggaaaaaagagctgaaacaggctgtgcgagctgtttggcaatctgctgtgaagcagtatgaagcggtgtatggccgtacatgatttcagcctcgagggattgaagcgccgcacgcagctggcggatttgccgcggccgttctgtataaatcttcgccatctcaaaacctgtccatgttgtcgctaccacaataaatacagcgcccagcagcttcagcatgttttcacgcccgtcgtcctagacagcacatttccgtctttgtcataaatttggctcactgtgcccggcccttttgctcttgataattccaaatagcggtcaaaggctctttcttcccacaaacgcttcaatgaaggccgcttcatcaggtcggatatgctccagccatgcgccgatacaattactgaaacaccagcatgcagtgcctccagaagtgcatctgtatcttccatacgcccgatttcatcgacaatcatcacctcagggctcatggatcgaatcatcatcatcagcccttcagcttttggacaggcgtctaacacgtcaattctctgaccaaattgatgttgcggaatgccgcgaagacatccggcaatttctgaccgttcatcgacgattcctgtctttacgggcagcatgggttttttgccggtgcttgagagcctcgcaaggtcccggagaagtgttgttttgccggtttggggcggtccgataatcagcgtattcagccagctgtcttgatataagtatggaagcagcggctccgcaatccccagcttttcccgggcaattcgtatattaaaagatgcgatgtcacggaggcctttcacacctccgttttccgtaatgactctgcccgccagtccgactctgtggccgcctctgatcgtgacataccctttcttcagctcttcttcaagagtatacatactatagttgctaagccggctcaggatcagatgggcatcctctgccgtgcccgcataggacaaataaacaggttgtcctcttcgaatcaattcaacagggcggttgatccgaattctgacttcttcgatttccagccattgttgttccggtatttcagaaagggcgtttttcatggattcggggagaacctcagcgatttcattcaacagagcctcctcctttctaccgattggcttctttaaaatgtatgatgtgaggcagactttatgacaagcctctctttatttatgaacacccgccaaaatcaaaacaacacccgtaaaaatcagaatcagctttgcatacgaaagctgcccggcaatttggtagattccgacagtcatcgtaatgataaaaatcaacggaccgacaatagcgagaatgctgttaaccacaaccgccttccggacatcgttggtcacaagcatgacaattgctgccgtcagctcaatcatagaggataaaactcgtaatcccgccattgttaaaacagtagaattgatatttccaagtaaaaatttcatagcactctcccaacctcccatttttttatatgatatgctctagcttggtgaagtagtcttgtcattttcgtataaaagaaagattctgtttttgggcacaaaaaaagcctgctcccatttgggaacagacttctttttttctttctatgctcttgaaacgtaagaaccgtctgatgtattgacaacaagtgtgtcgccttcattcacaaagaacggcacgtttacaacaagcccggtttcagttttcgcaggttttgtaccgcctgacgctgtatcacctttaataccaggttcagtttcaacaactttcagctcaactgtgtttggaagttcgataccaagtgtttcatcctggtacatcatgatatgcacagacatgttttctagcaggtattttaattcttcttcgatttgagttgcgctcagttcaagctgctcataagaagaagtatccataaatacgtgctgatctccgtttgcatatagatattgcattgttttggtttcgatttgcgctttcgctactttttcaccagcgcggaatgttttttcctgaatggcgccagtgcgaaggttgcggagtttagagcggacaaatgccgcaccttttccaggttttacgtgctggaagtcaacgacgcgccaaatgccgccatctacttcaattgttaatcctgtacggaaatcgttaactgaaatcatgtttaatgtcctcctatattccaatcacaaaataataagttcttttggggaatgggtgattgtccggttgccgttttctgtaatcacgatgtcatcttcaatgcggacaccgcctgtttctggtatgtaaatgcccggctccactgtgaccaccatacccggttcaaggatagctgaagatctgacggataatcccggagattcatgaacttccatgccgagcccgtgcccggttgaatggccgaaatagtcaccgtagccttttacagcaatatgatcccttgtgagggcgtcagcctcttttcctgtcattcccggcttaatatgtgcgacgccaagcgcctgagcatcaaatacaacctgatagatctccttcaattgatcactgggctgacctacagcgaccgtccgggtaatatcagaacaatatcctttataataagcgccaaaatcaagcgtaacaaggtctccgctttcaatcagtttgtcactggccacaccgtgcggaaggcttgaacgaaggcctgaggcgacaatcatatcaaaagaagagctgtctgctccctggcttctcatataaaactccagctcattggcaacagcgatttcagaaataccgggtttcataaacgtcaagatatgtctgaaggcatcatctgcaatcttcgcagcttcctctaatatcttaatctcttcactagacttaatcaagcgcaacttttccacggattcagccacaggcactaattcggcatcactgataacggcgctgtatgaagcgtaagtgccatatgtcatgctgttctgttcaaagccgagacgcttgatgccaaacgattcaacagtgtcggcagtggtctgaatcaagctgccaccatgttcaatgatctcaaaaccctttacctgaaccttcgcctgctcagtataacgaaaatccgtaataaacgctgctttgtcacccgatataacagccaaacccgccgaacctgtaaaccctgtcatatagcgtacattcgtgctgcttgtaatcagcatgccgtcaattcccagctgtccaaacaggtttcttaatttctctagcttcatcttgattctcccccttgctggcttaataagtagcgaacagcaagcttgtagccttcagctccaagaccgacaatctgccctttcgcaacaggagcgataaccgactgatgcctgaattcttccctggcgtataagtttgataaatgcacctctaccacaggaagactgatgcttgaaacagcatccctgatcgcatagctgtaatgactcagggcgccggggttcagaacaatcccgctgtattgctcctcagcctcatgtatcgcatctatcaaatcaccttcgtgattagactggaagaaagtgagctggatatgtaaggcttcagcaaactgaaaaagatctgtttcaatatcggtcagtgtctggcggccgaatacttcaggctcacgactcccaagccggttaacattcggtccgttcaaaatcaaaaaatgaggcacataatctctcctttttgcgagggtttctcatgtaaaaaatgttcacttctcgtgaacattttatcatactggaaaaggattatacactattctctatgcattcccagcgcacgtgcaagcttttccgaattcagctcattgtattcaaatgaaatggaatacccgacaaacagcccgtaaagcaaataaatgcaaatggtcgtaataattgtatctgatgtcagttcggtcaccgtgcgcacatctggaaaaatcggattaaaaacaaaaaacacgagcagccaaagcaccaagccgtataaaatacccggccacattgtttttaaacgtttcaatagaagaaaataaagaaatgctgcgccaattgaaattactccaatcaaaatgatgctgattaccgttcccagcccatgttttttccactctccgagcacaaacggctgcaatatcatattcgggctgatttcggaaaaatgaaacaaatatgcgatataagcaacgaaactccaaagtacgcctccgcaaaaacctgttgccgccaccctgccggccattgaaacaggcggcttttgcttctcattcaattcttcattttgttctgtatctttttcgcttgtcatcatggcacctccagttaaagtgtgcccaaaaaaagaaatgtcaataaaaaagctcacactttttgacagctgcgagtaaaatttgaaaataacgggtataatgcatgtagaaaaagcaaggctatggcaattttttcagcttgtcaatctagaggtttagcgctgtttcctgtacaatagagtgaaaggaaatggttagcaatcctaaagaaataggcaggttgataatatgtcaaaacataaagttccgcccgcttacggcgggcaggctgttgtggaaggcgttatgtttggcggaaagcatcattacgttacagccatcagaagaacggatggaagcattgacttttttaagcttccacgcaaacacaacccgaaactgaacatcgtgaaaaagatcccgtttttacgggggatcgcggccattatcgaagcgagtgcaaacggcacaaagcatttgaatttttcaagcgaacgttacgggctcgatccatctgaagacgagacacttgagcaggaagaaaaaaaatcctccgggctgtctatgtatctcagcctcgcagttataggcgtcctatcatttttgttcagtaaattcgtatttacattggttccagttttcttagctgaactgacaaggccgattttttcctcggacacggcgcaaatcgcggttgaaagcctgtttaagttgattttgctgctcggttacatctattttttgtccatgacaccgcttattaaaagagtgtttcaatatcatggagccgaacataaagtcataaactgttatgaacagaatttgccaattactgtggagaacgtccaaaaccaatctcggcttcattaccgctgcggatcaagctttattttatttacgattattgtcggcatgtttgtttatttactcgttccgacagatccgctttggctgcgtgttatagatcgtgtcgcactgataccggtcgtgcttggtatatcctttgaagttctgcagctgaccaacaaagtgcgtgacattcccggtctgaaattacttgggtacccgggactgtggcttcagctgttaaccacaaaggaacctaaggatgaacaggttgaagttgccatcgaaagctttaacgaacttctcagactcgaagcattgtctgagcaaaatcagaagccttctcacaacgtcatctaaaatccgttgccctgctattactttcggaggtggacagttatgaatcatcgtgtacaacctattattgctgtattaattgcgctgggagcgttcggtttcctctatgtgctggtaaccaatcccggagaaatggcaaaaatggcggtaaccgtcatcgtggcaggtatcattatttattttattgtgaaatatgtaatgaatcgaaatgcgggcagcgaaggagcagccttcaaaaaagcggcgaaacaatcgcggcgccggatgaaagaacataaagcaaaacaccgcgccggacataagggacgtgtcagccacctgcgaagcgttccgagcgccagcaagcctaagccgatgattctcaagaaaaaaagccagactcagctgactgttatagaagggaaaaaaaataaaaagaaaaacagagcgcttttttaataggtccactgctttaaaaacagctctgtccgtcttttacctagctcaatcagggctagttttttttgttgtgttaaatgaaaatcagttgccattacgccatcaaccgggagaaaaatgatattttgttcatagcgtgatgcaatgtgccttgcgtcatgggcatccttcatcgtttcaaacagggcgccgaacagttcaaaagcgttgcggatattttttttcggacgctctctttcacgcggcgcaagcgtcacaccgatcacagggcgctttctttcctttgaaaacagccagatggggaaattgcttaacacacctccgtcgacaaccgtggcggtgcctgtgtccgtttttaattttatcggttcaaaaaaatacggaatgctgcagctcattctgaccgctctggcaaccgggaacatatcgggatttaacccgtaacgggccaaatcgtccggcaaaacaatcatggtgccgtttgtcagatcagaagcaataaggcgcagagaccctttctgcaaatcgccgaaaacccttatgcctttcgctcttaacagatcagcaatccattcttctatcgtatcgcctttgtataagccaagacgccagtagatggacacccactggagcatttttaaggggagaaaagagtacctttgatccagcaatttctctccgtccacttcttcaattaaagcgtggatttccttactggtgtaacctgacgcaatgaaagcggcaataatggcgcccgcgcttgtacccgcaacccttttaaagcggaagcctttttcctcaagcgcttcataagcgcctgcaagcgcaatgccttttactcctccgccggaaaacacaccgtcaatatacatctcattccctccccctccatccgatcgtttattaccattttaagaaaacacgcgcagaaatagaccaactaatgacgggtggcgtcagcgtatcaaaaaagacggcctccttcgagaccgcctttttactgattatgatgttctgttttcttttggattgatttcagatcttttttacgggcatcatcttcttcaaaatattgaacaagatccccgatgcgatcaatactgttccagcttaaatgatgttcgattccttcgacatcgttatatattttctcttcatcaacaccaatgattcttaaaaactgctcaagcaattcatgtctgtataccagccgtttgcctatttttttccctttagacgttaacacgagaccgcgatatttttcataaattaaatattcgtctttatctagtttttgaaccatttttgttacagaggagggatggactgccaatgcttccgcgatatcggaaactcgtgcatatcctttttcttcaatcagcatataaatctgttcaatataatcttccatacttggtgttgtcatcgaaaccctcccaaaaagcaccttaactttataaaccattacaagtttacactaatgaacttgaaaaaacaaggatgctccgcgggtcaaaagccctgtttaccgcttataattccattcatctgaagcgtactttgtttcagccaagtgatgaacaaaatcaagctcttcctgagaaagttcatatggctccaaatgaatgttaagacctgtttcaaatccttctttaaaggctttacgagcctcatccatcgtcacccgcttttcggtgagttcattaatggcaaccgctttgtttttgaaattgcgctgcatccgctctcttactctttcacttggatataagaacagatcgaacagcttgtcctcatctaaatcaagaagaatggagccatgctgaagaatcacacctttttgtctcgtttgcgcgcttcccgccaccttgcgcccctcaaccactagttcataccacgaaggcgcgtcaaaacaaacagatgaccgcggattttttaagctttctttttctttttcagttctcgggatggcaaagtaagcgtccagaccgagatttctaaagccttgaagtatgccttctgaaataacccggtaagcctcagtaacagtcgccggcatctcggggtgctcttccgaaacaattacgctgtatgtcagttcctgatcgtgcagcacacctctcccgccggtcgggcgtctgacgaatccgagattatatttatgtactgcttcaaaattgatttcctttttaatattttgaaaataccctacagaaagtgtcgccggattccagccgtaaaaacggataaccggggggattttcttttcgctgtgccaatataaaagcgcttcatcaagcgccatattgaatgcaggacttgcattgcctgagtctataaaccgccaagtttctttttgcattttaagaccttccttaccgttttaatagaatcagtttatcaaactgtcgggaaaatgaaaaatattttagttccattatagatgacaatcacgctgtgctttactataatagtatttgtcgaaaacggctctatgaccttgttttatgaagcagggttttgattttatatgctaaaggagtagaatcacattgtctaatatgatcgttttgattatttttgctgcgtttatcatctatatgattgcttcatatgtctatcagcagcgaattatgaaaacacttaccgaagaagaattccgcgcgggttaccgcaaagcgcagcttattgacgttcgtgagccaaatgagtttgagggcggacatattttaggcgcccgcaacatcccgctttcccagctgaaacagagaaaaaatgagatccgtacggacaagcctgtttacctgtactgccaaaacagtgtccgcagcggacgcgcggcacaaaccctgcgcaaaaacggctgcactgagatttacaacctaaaaggcggctttaaaaaatggggcggaaagattaaagcgaagaaataaagcaaacagctgtctggtagacagctgtttttatttatctttctaccgcctcgtatctgagcaccgggtgtctcgccgcttttgtttcatccattctttttacaatcgttgtatgcggggcctcctgaacaagttccggattctcctccgcttcttttgcgatttgaatcatagcatcaataaacgcgtccagtgtttcctttgattcggtctctgtcggctcgatcatgatgcattcttcaacattaagcgggaaataaatcgtcggcggatgatagccgaaatcaagcagccgttttgcaatatcaagcgtacgcactcccagctttttctgccgcttccctgataatacaaattcatgcttgcaatggcggtcaaacggaagatcgtaataaggcgcgagttttctcatcatataattggcgtttaacactgcgttctcagtaacagcctttaatccgtcaggccccatggagcgaatatacgtatacgctctcacattaatgccaaagttgccgtaatacggcttcacacggccgatcgcatgagggcggtcataatcaaacgtaaagcgcccttcttttttgactaaaactggctttggcaaataaggaatcagatcttgttttacgccgacagggcctgagccggggcctccgccgccatgagggcctgtgaatgttttatgcaggttgaggtgcaccacgtcaaatcccatatcaccaggtctcgccttgcttaaaacggcatttaaattagcgccgtcataatacagtttcccccccgcttggtgtacaatttccgccatctctgtaatctgctcctcaaacaagccgagcgtgttcggattcgtcagcataagagctgcagtttcttcattcactgctctttttaaatcctctaaatcaacaagccctttttcattcgatttcaccgtaacggtttcaaagcctgctactgttgctgatgcaggattcgtcccatgcgcggaatcagggacaatgaccttcgtccgcttgaaatccccgcgagcttcatgataggcacggatcatcatcagccccgtccattcgccgtgcgctccggcagcaggctgaagcgtaacctcatccattcccgttatttcttcaaggtgtttgcttaaatcatataaaagctctaatgcgccttgcaccgtgtcttcatcctgaagaggatgaatcgcagcaaaaccaggaatacgtgcgattttttcattgattttcggattatatttcatcgtgcaagaaccaagaggataaaaaccggaatccaccccgtgattgcgtttggacagcgctgtataatggcgcatgatgtccagctctgaaacctccggcagcgctgcgtcttcgtcacgaatataggtgtctgacaagaggtcccccaattcgatttccggtacatcgagctccggcagactatagccgattcggccttctcttgaaagttcaaaaataagtgcctggtcctgattactcatggcgatcccccaattcctgaatgagtgcgtcaatttcttcttttgttctcagctccgttacagcaatcagcatatggcagtccagctccggatacgtcaacccaagatcatatccgccaatcatgccttttgccagcaaacgcttgttcacagctctcaccggctcatccagtttgatgacaaattcattaaacatcggcccgtcaaacataacagtaaggcctgctttttttgcttcttgctttgcatagttggcttttaagagattttggcgggctatatcttttacgccgttttttccgagagcagtcatggccactgatgctgcaagcgcatttaaagcttggttcgagcatatatttgatgttgctttatcccggcggatatgctgctccctggcttgcagggtaagcacaaagcctctttttccgttttcgtcttccgtttgtccgacgagacggcccggcacctttctcattaattttttagtaacggcaaaaaagccgcaatgcgggccgccgtatgctgaaggaatgccgaaaggctgcgcatcaccgacgacgatatcagactgaaacttgcccggcggagtgagaagacctagcgccagcgggttagctgaaacaataaacatggatttcccttgatgagcgataggctcaatatcctttagcggctcgatcctgccgaaaaaattcgggtactgaacgatcactgcggctgtgttctcgcaaacggtttggcgcaatgcatcaagatccgtaacgccatccgcagcgggtacttcaacaacatcaatatactgaccttttgcgtacgttttcagcacctctcgcgattcaggatgcacggtttttgacacaacaatttttttctttttcgtgtggcctgaagcaagcattgctgcttctgccaaggctgttccgccgtcatacatcgaggagttggcgatatccatgcctgtcagttcacagatcatcgtttggaattcaaaaatagcctggagctctccttgtgaaatctctggctgataaggcgtatatgcggtataaaactcagagcgcgaaatgacatgatccacaatgacaggctgatagtggtcatatacacccgctcctaagaaagaagcgtattgtacggtatcacgatttttagaggccagctttgtcagttctcttgttaattctgtttctgatttcgcttttttgatttgatactcttttttatatttgacgttttccggtatatcagcaaataaatcatcgatgctgcttacgccgatagtagcaagcatctcctgtttatccttttctgttgcgggcaaataacggtgcttcatgtgttgtctcctctctccaagaaaaaatattagcgtttataaaatggtgttttgacaacctttgctttcactaattttttgcgaatctctacatctacaacagtcccgatctcacttgtttccgaatcaattaaggcaaggccgacgtttttccctaatgtcggtgactgcgtgccggttgtcacctttccgacagacttgccattttggaaaacctcatatccgtgccgcggtatccctttttcaatcatttcgagaccgacaagtttgcgcttcgctccgttttctttttgttcactcaatactgacttaccgaaaaagtcagactccttattgtgctttacagcaaagcctatacctgcttcaatcggtgtaatatcccgggtcagctcctgaccgtagagcgggagcttcgcttcaaaccggagtgtatcacgtgcaccaagaccgcatggaatcaatccgtatgcatcccctgcatcgatgatttttttccaaatatgcatagcatcatcactgcggcagtaaatttcatacccgtcttctcccgtatagccagtgcgtgaaataagtgctttgcggccgctgatatcggcttcatcaataaacgcaaacggctttaatgcagacacatctgcatctgtcagattttttaagaccgcttctgctttcggtccctgtacagccaagagcgcgatttgatctgactggttgtcaatctgtacatcacctgctgcatgttctttcatccaagccaagtctttatctatattagaagcattaatgacaagcagatagcggttctcttctttttgatagataagcaaatcatcgacggttccgccatccgggtaacacatcgctgtatattgagcacggcctggcgttaacgcggaaacatcatttgtcatcaatctttgcaaaaaagacagactgtcgttccctgacacttcgacttctcccatatgagatacatcaaacaaaccggctgcagttcggacagcctcgtgttctttttttatagaagaaaattgaacaggaagctcccagcctccaaaatcaatcgtttttcctccatattccttatacaggtcaaataacggcgttctgttcagcatctaattcctcccctttatcaacggcgcagctaaaaacatacaaaaaaggacagagaaacacctcatgtaaaatgaaggttctctgtcctggcacctgaaagtttactttgcatacgcaaagacgtcccctttggtggtttgcgcatccgcacaaacactctccagagttgcgtcgagcaagagttcttttgcctgagagattcactccgcagtttgctccttcggcgcctgtatcccgaggttttcggtcaggtctctccccttgctgtcattcgctcatattttcatgctgttatggacatactatagcaatatcttacatcaaatacatactcatatcctaccatcatcactatatgctgggcaacagcaatttgggcagatttttcttatattattcatcttaagaatcgaagaattagaaaggcggtttcaaagcaatgaatacagaaatgatctacgatgcaaaatggcctgaagaatttgctgaaagactgaaaaacgatggcccttgggcaaactgggaactgtacaagctctctgcagaaatccagaaaacattagcaattccagattttgaaggcttacgggctcctttatatctgccttcctttacgccgctcccccaccagcttgaagtggcgcaaaaagtggttgaaaaaatgaacgggaaagcgattttagcagatgaggttggtctcgggaaaacggtggaagccggtttaattttaaaagaatatatgattcgcggattagcaaaaaaaattttgatccttgtgcccgcttcccttgtgtcacagtgggtcaaagagcttcaggaaaaatttttgattccggctgttgaacaaaagaaaagctatgtgtgggagcaatgcgatattgtcgtctcatcaatagacaccgcgaagcgctcgccccatcgagaaatcgttctgtctatcccatatgatcttgtcattattgatgaggcacacaaactgaaaaatagcaaaacgaagaactatgaatttgtccggaatctcgtaaaaaaatattgcctgcttcttaccgcgacgccaatccagaaccgtatcgaagagattttcaatttggtgtccttattaaaacccggccatttaggcagtcagaatcactttcaggaggagttcgccaagaagaaatccagtttagaagcgcatgaacatttaaaagatcttgtgaataaagtcatgatccgtaacaggcggcatgatacagggctgaattggaaacagcgccatgttgaaacagtgccgattcaattttctccatcagagcaggcgctttatgatgaaatttctcgcttgaaggaaagtatcaataaaccagccagcatgttctcgattatgaccttgcaaagagaatgctgttcgagcagagaagcggtgtatatgacgctgaaaaagatgctagatcaaaaagagaaacaagcacctgccattgatgaggatacgatttcagttttaatagatcgcatcaatcaagtgacacaaaactctaaagcgcttcaagtcgttgatttgatcaaaaaaatcgacgataaggtcatcatttttacagaataccgtgcaacccagatttatttgcagtggtttcttcagcaaaacggcatcagttctgtgccgtttagaggcggatttaaacgtgggaaaaaagactggatgaaggatcttttccgcgggaaaatccaagtccttattgcaactgaagcaggcggtgagggaattaacctgcaattttgcaatcatatgatcaactatgacctgccatggaacccgatgcgacttgagcaaagaatcggaagaattcacagactcgggcaggagcgtgacgtgcatatttataacatggcgacaaaacatacggtggaagagcatattctaaagcttttatatgaaaaaattcatttgtttgaaaaagtggtcggtgaacttgatgatattttaacgaaaattcaagtgaacaattttgaagagcatctgcatgacattttgtatcactcagcaacagaagaagaaatgaaaataaaaatggataacttaacctcatttttgtcttataaaaaacagcagcctgctgaaaaaagaggatcttagcctgtaaggaggttttattagtgagacagcaagaggttcacgattttctgctgcgtttttttcaagcaaacagctgccaaatcgtcgatcaaggcttaggctatatgacagtgcagcttacagttgaaatggacaaacaaatcatgaaccgccctttctactggcattggcgcgagaagacaggcggtgatccgaatccaatgaaaatcacttttattacagataaagaaaatgcgccaaaagacctagatggtgaatttatatattttggggccccgcgtctttttcaaatatttaaagctgttaaacaaaatgggagatttaccagaatgtatgagaaaattgaatcagccggagctaaagtcccacttcagccttggcttggtataaatgtcacgatttcataccagtccgacatgaaaaaggataagttattgtcactaggtcttcacctagtctctggaacgataattgaagattttcaaagcaagctgacccagttttcactgacgtctcaaatatgtgactattgcttcaccatttcacctatgatcaaaccagaaagcggacttaagcgtatggaaaactatatttccaaatccgctatgcaggagccatccgactgggcggaacaggcggttaacaggtggaagaatgatatgacattgcttgataagttttacgagcatatagaagaaaaaccagaagaataccatctagaaaaacaggcgctgaaaaccttgtatcaaccaaagatatcagttgaaattgaaaatggcggattgttttatctgcaaaataatatttcaagctaacttttttaccattcgacatcattctcgttttttttgagaaaatacgattataataaaggtatattggaaaaaaattctggtgatttaatggcaaatgacttccagagactaatgaagcatacaataagtcatggccggactggctgaaatacataaacaagtattttaggaggagaaactgcatgaagaatgcaaaacaagagcactttgaattggatcaagaatgggttgaattaatggtggaagccaaagaggcaaatatcagcccggaagaaatacgaaaatatttacttttaaacaaaaagtctgctcatcctggtccggcagccagaagtcataccgtaaatcctttctgaatgtgctataatatcacaaggaaggtgatgacattgattggccagcgtattaaacaataccgtaaagaaaaaggctactcactatcagaactagctgaaaaagctggggtagcgaagtcttatttaagctcaatagaacgaaatctacaaacgaacccctccattcaatttctcgaaaaagtctccgctgttctggacgtctcggttcatactttgctcgatgagaaacatgaaaccgaatacgatggtcaattagatagtgaatgggagaaattggttcgcgatgcgatgacatccggggtatcgaaaaaacaatttcgtgaatttttagattatcaaaaatggagaaaatcccaaaaagaggagtagtgcctgagcagaggcactaactcctcttttgtcaataaccatcgagacggcccagtatatgaatactgggccgtctctttttatggctgttattaatttttatcctcgctgtgcgctttttcattttctttcacataaccgtctttatcagtatggtcctttttgattgtcaagccgttccactgtgtagcttcgaacgagaattgaagcttaatggagttgccttgatatttattttgaaccataagcccgttttcatcttttgttttatcatctttgaattggatttccatttgaacctgatcgaagtcagttggtgtttttggaacaccatcatattcaggagcggttttaccgtcaattgttgctacattgactttaccgcttgcatttaagaatttagggtcaatttgttttttgattttttcagtagccgctgcatcatttttagcagacatcaaatacaagtctttaaggttcgcatcatctaaaataatgtttttcgggtaaccattgccgccctcttttccaactgtcaacaatgtcacttcaaactggctgaggaaatcttctggagatgtattgctgccgccgtttgctttaaaatctccataattaagcgccattaaaacttctttgatcgcaagtgatccgttattttcaaattggaaatcctttgtcaacttatctcccggctttagatttgataagttcacactcgctgaattctctttagcagataaatcaagcgtacctgatgcaaaagtagcatcctttgatttaatgtcgttaaatgctgcccatgttcctcctccaactaaagctaatcctagtgctgcagaagcaactcctaaactcaatttctttttcatacccatggtaaactccccttttattgaatgattttatatcgaaacctgttgccaggtttacaactgaagttaagtagacatggtgctgtcctttgtatctgtttccaaggcttttgtctttctttcaatttctctaatggcgctgctgatcgtcacaaaagcgtacactaacagcatcacgccgggaacaatcaataatacagccgttccaatcggctggctggcaaaatgaagcatatagcctgcatatggaagctgaaaacctgtgtattgtgcgcgaacattttcgtccgatacaggcgctgaatcagctgctgcattattatcaccttttgttttaaataacaaatggtctccttgctttgttatgtcaacaattctgtgggtgacagccgtatttgcatcctgcataaatgtaataacgtcacctttttgaagctctttcacatcagcgatttcttttaccaatattaaggaacctgtattgaactccggctccatcgaacctgacagaactgatttcagcgtatacccaaacaccgccggctctcccccggatgaacgtgttgaaatcacgacaagtgtcagcacaataataagagtaaagatgatcacgtataaaatattactgatcagcttcattgcttttttcatcctcttccccgctttccttctggtctgattgagtttcattttctttggttacagcttcttgagatgtttcttctttcattgttttttcctgtatatccttttgtgttgtttcattctcctttttgacgtccgactttgtttcttttttagggactgtcggtttttcatcgcattttgcaagcgtcataggctcggaccactcaaatgtactgccgtttgccgggtagcctgccggtttatatactttaaatgcataaatgccgggtttcatttttttcttcgtctcaattttataaagtgaatcgccgatttgattggagacaaatcctttttcgatcacgttcccatcctttaacggtttgcgggcattttcaagcttatgaagctcccacttccactttgatttcttaagtttctcacctgtattttcgagcacagcaaataaggcgaaaggtgagcatacagtgcctttcgtatccgtttgatctgatatgtgcaaatcactttgatcccagcgtttatcataatggcagtttttatctgtatgctgaaagtctttacacgtttgaagtgagacatcaaatgtttcaatatcatgaaaagcagcgcttgtatcatcggaaaattgtaagcatattgcggcagtcagactgaaaatgactgaaagctgaaagataagcagaactttcagtttcgtcttcgccttttgctgattgtgaaacaatcgaaacatatcttacctcctgtaaaacactgtaacttgatatgacaatcgttctctttaaagaactccacaaatagagtataatcaacgatttatagatttaaaaacaccgaaatcgctcatttcgttcgtttaaaagaatgttttcatcatattacaaagtcttgctcagtattgctcattttttcaattttttagaaatttttgggattgttatgtgagaatttaaatgcatatcccattattatttggtaataataaacaaagaaagggtgacagcatgatgatcaaacaatatgtgatttgtctatctcttctcgtctttggcaccacagccgctcacgcagaagaaacaccgcttgtaaccgcccgccacatgtccaaatgggaagagattgctgtaaaagaagcaaaaaaaaggtacccgctcgcacaggtactgttcaaacaaaaagtatgggaccgtaaaagaaaagatgaagcagtgaagcaataccatttaactctgagggaagggtcaaaagaattcggcgtttttgtaacgatttcatttgatccttatagccaaaaggtcaataaaattgccatattagaagaatatcaataaggtcctccattttttgaaggaccttattcatttatttgcggttattttttccgtttcagccaaagtcggaagccatagggtaaaataccgaaccactgctgggaagcaggcgtttttgtttctttccacacctcttttcgttcttttcgctcatctctcggagtatctatatatttgacaaattgctgcgtcatatatttaacataatcattcgttttcacgtgatcacctcatcattcaattattatgagtgttgtctcacatgactttttttataccctttacactgttttattctgtccatctcagcagctttttctgtttttggtcaaacacgatctgtgcagttctttctgttcccgactccgttgacactcttaagttgatttctttttgttcttttatcgatgtatcatgaatgtaataagaaacccgtccatatggaaattgctgcgtaccctcctggcctttccgttcctctagaacatgccgaatcgaaagaagcaccccattttgaagcaaattctctcctatgtataactcttttgtttccttctcaaacatgcagcgtgaaatatattgagcagcagcaaagttcacgattaacagcacaagcgctgacacaaaaagaacagctgggtaaataaaccctcttgtacaatacattcacccccctcctaaatacgaatagactggaaaagcagtttgatacactttttggtcctcactctcaattttcagcaaaacaacacaattttcaaaatcagctttcatggcagtaatatgatctaaaatcggaacatgccctttaccatccactctttttcttatcattgaatgataaatttcgaaacggatgtcctgcccggaaagattggtgcagattaacacgctcccatgctcggctgtcttaactgcctgtgactccttgcattcattcatcatctgttctatcgaaatcatccattcttgctgtgtgaaaccgtcatgttcctgctgtcgagacaaaaacagatggaaaatcgcagctaacgatcctgatatgagcaaaaagactgagagcgaaaataatacgttaagaagcgtatagccattctgtctgcaggatgctgaggcaatatgatttctctttataagctgtggctttgatacatacgttttgatattcgccctcctcctcccacttcattgcatagatatgattgttctttgtaattgtttttgacgcggctccttcaccactcatgacatatttgctaatgctctcattcatcatctgatagccgatttctcgtgattccgccattttttcatcagctatcagcttgtcccacaaggggacgactgtcagcagcacaaacagccacaggcttagcgcagacattgtttctattgtagaaaaacctttattttctctccacattgactctcccgctccctagataaactgttatatcatatacggcatggccatttactcgtatttttccgcctgcattcgggtgccctttctcattaaattccaaacggtcttttaatgtcagcagttctatagaaagtccccttgcatacggacgttcaatgaccgtatcaccaatgactaattgatattcttttttatgaaagaaaatttttgttctttgttgacgggaaatagcaacctgctgtgtgagcataatatcatttttcagctgccttgctgcctgtcggacagctgtattgtcataagcaggaggaagtgtagtgaagacggccaccaggaggatagaggcaaggcttaacacaagcaaactttctaaaagggtaaacccctcctcctcgtttaatttaatgttcaaccttaacttctccgccggtgatgataatgcgcttaccatttggacagacagcatcgtttttcacatagccctctgactgtaaatcggcaaggctcggagtttgtccttcatgatcaagctcaaatgcagtcatttgtgccttaaccatgttttgtaagccttcacagccctttttttgaatggtttggttatgtttcgtgacgttcggtatcgtaattaaaagcaaaatcgaaataataaagagcacgattaacatttcaacaagtgtaaatcctttctcattcattagcctcttcctttcacatttgattcatcatctgatacataggcacaagcatagataaatacacaagtaagatcatcgctgcaacaaatccataaatcattggctgaaggatgcctgtccatttttgcgctttgtgttccagccgctgtaatatgaattggctgtatgtgaaaagctcccgatccaatcggccgctcagctggccgtgagatatgacttttgataaatcagtttcataaaaagggcttccacaaatagcggattcaattgactcaccggcttttagccgttcaatcaattgttcagcctcgcagcggtagaaagggagaaacgtttgatgtttaaatgcattaaggctgtcataaattgagaggcctgattttaaaaggctgcttagctgcaaagaaaaaaagtagctgttaaacagcttgacaagctttccaaccaaaggaatcctgatacaaatcagcatttgccgggcaggtgattttttcttaaacacaagccaataataaatcccgatacctgctgtaaaaagaacaagcaaaatgatcacaagatcaatatgctgaaaaaaagcaaaaagtatatcggttgaacgtgaggtttccatattcatcgattgatagataccggaaaactgaggaatgatgatggactgtaacatataaaacatgacagcgaccgtaaagatgaggaaaagcggatagcgcagcactcttttcagctggtctgcctgtgcaatttttcgttccagcagctctccgctctggatcatggaagcaggcagttcaccatgtgtttcagcaaaataacaaatacctacggcttccttatgaaatgacaaactctttagtacttgataaaacggagccccttccctcaaacaagtgaccgaatcagtcaagtcagccgcctgcctcttattcatctgaagttccatcaggcgtaatccatccagaagcgtatatccgcccgcagtcatttcaccgagcctctttaataacctcgcttgatcctttaacgaccagacttttctaatctttttcatgataaacccaccggtcatagttgtttgtcgttaaatagccgagcgcaattccttttctgataatttgacgaagcgtttgatattggtaatttgcatgatttccttttgcctcctggatacattgctgaagatttttcccgtatagaagctcataaacgctagctctcctggtatttcgtgactgtcggcaatacactgatgaacatccgttttcacaaaacgggcaagccaaatcaaccaagcgctgagccgctattgcaatgacagtctgttcgatttcattcatattgataccgaattcaagcagtctgtaaattgcgccctttgcgtctctcgtatgaaggctcgttagtaccagatgtcccgtcatcgctgcccgcaccgcaatttcagctgtttccgcgtctctgatctcacctaaaataatcatatcggggtcatggcgcaaaattgctttcagacctgcggaataagttacaccggctttttcattcacctgaacctgaagaacatcttcgtcccttgtttcaacagggtcctctaatgtgacaatatttcgattaaagtgtttttttgcatattgaacgagagagtatagtgtggtagtcttccctgaaccagttggcccggtaaaaatgagcatgccatgggaatgttttaaaaacgagagtaatgtggctcctgtcttcggaaatagcgacaatttatcaatcgaagggatattgtattggggcatcactctgatcacgaggctttcttcattaattgtgggcagcgttgacattcttaaatgaacatttccctctttcagctttaacgtaagcgaaccgttttgcggctttcgcctttcacctatatccattgctgaaagaaatttaaaatgtgaaatcagccttacgcactcttcttttttcatgtccctttttttcagcaaggcatgatcgacccgaaaatgaatgatagcgtcccgctccctcggcacaatgtgaatatcagaagcctttgttagatatgcctcttcaatcaagtttttgcttaccttttctattgaatccaatttgattccctctcctttcaacgcatattgtagaaaaagaagaaagggtaatcaaacaaggaaaacgtgattttgtgagatgttatatgctgaaaaaccaattctttctggcaagaaaaaaaattttcaactgaatgtgccgctgtcattataattttccctataaataaaaaagcagacatggtcaccatgcctgcttgattccattttcattatgctgttttcgctttttgaccagtatctttttcaacggaaaggtcgcctaatgcaacaataccggtcatttggtcattttcaagaatcgataaactgcggatttgatgctctgccataagcgccttgacatcgtatccggtcaccctgatatgtctggtgaaaaagcggggcacgctgcacaaaatatgaaacatcctatagagtccgcctttttcgaggtttctttttcttcttccgctcctgcagcatatctcccgtccagccttttttcctcaaatagagatagatcaggactgtagatgtgacaatcaataagagagaaaagagatatccgtatttccaattcagttccggcatcactgaaaagttcatcccccataaggcacccagagctgtaatcggcgtaaaaagcgtcgtgaaaatggtcagtgcttttacaatttcattccccctgtgtgaggtaatgacttcctctgaatgcagcagattgttaagctccccttcaaattcgctgatgtatgtaaatcccctgtcaattttcagttgtgtccgctgataatcctttttcccttcattttgaggtaaaaaggtttctttcaacgccatttcaatttttttggcgcttaatattaaatttttccaaatcatcagttcatggcgcaggagatggacgcggtttagaatgcttttgctattgtcgtctttaatttgccatctgagctttctcagctttacttcaaattcatcaacaccgattaaatacgcattcattagttcgccgagaagaattaaaaacccctctatcgcattgtccgctctttccatttgccggacaacttctttgcctttaatctctctcaaaatcgaaaagtcaaaattgattgtgaaaaaatattgtctggtgatataaaagtgaaaaacagtatggtctttttcttcaccaagcccctgatcataaacaatcgacccaaataccgcttcattttccgtttcagttgtatctactcgcaaaaaattaacgtgatggttattttcaaaccacttttcacactgaggccagtgagaaaaatggattagatctcttgccttacttctttcttgaggccccatttggtaccaaaaccaatcctttcctgtatgtgccttcatgtcaagatcctccaaacttttgttctttattctttaattgcccaataaccgcgtcactaaaccagtctgccgcttcaacacatgttttatgagcattttcaggtggtatggaatgtagaaagacatcggaaaagggaggtgcatgccttccttggagaaggcagttgttttggaatttatcaatttactagcagtcgctattctcattttgttaacaggattttttgttgccgtagaattttcaatcgtaaaagtgcggcgatccaaaattgatcagcttgtcgcaaaaggaaagaaaggttctaaagcggcaaagcatgtcatcactcaccttgatgaatatttatcagcctgtcagctgggcatcacagtcgcagctttaggactgggatggcttggggaaccgactgtgcaaactctgcttcgaccgctttttcataaagcaggcttaaatgaatcgcttacccacctgctttcactcgtcatcgcatttttagtggttacgtatttaaatgtcgttattggggagctggctccaaagagtttcgccattcaaaaagcagaaagcattaccttgttgttcgctaaaccgcttatttggttttataagatcatgtttccattcatttggctgttgaaccactctgcccgattgattacaggagtgtttggactgaagccggcatcagagcacgagctggcatatacagaggaagaacttcgggtcctattggctgaaagctataaaagcggcgagattagaaaaagtgaattaaagtacatgaataatatcttcacctttgataaacgaatggcaaaggaaattatggtgccgcgaaatgaaatggttagtttatcactagatgaagactccatttcaaatcttcaggaaacagtcaagcaaacaaaatatacacggtacccagttgtaagagaggataaagataacgttattggcgtgattaatatgaaagaagtgctgttttccatgctgacgaaagatttttcaatcaagaagcatcaaattgaacctttcgtacagcccgttatccatgtcattgagacgattcctatttataaactactgctgaaaatgcaaaaggaacgcactcatatggcgatcctcatcgatgaatatggcgggacgtccggtttggtcactgtcgaagatattatcgaggaaattgtaggagaaatccgtgatgaatttgatgcggatgaagtgcctcatatccgcgaacttggaaaggatcattacttgttaaatgcaaaattattaatcagcgatgttaacagcctgcttggaactgatttatcagacgctgaagtagacaccttgggcggctggtttttgacacaaaacatagacgctgagcctgaaagtaccatagaatatgatggctactcttttaaggtaaaagacatcaacagccatcacattttatttatagaagtaaaaaaagctgaatagcccgtgaaaggctgttcagctgctatctttcaagataaacatggcaaaggcatcaacactcttttattttaaaccctttattggccagggctttagcaagactttgctcggttttcacattcgaaaaatccagacccagcttcacgacagtttgggcaatttccggcctgattcctgaaataatcgtctcaatgccgagcaatttggtgctgtcaatcactttaaaaatttgataggctaccatggtatcaacgataggaacgcccgaaatatctaaaaataaatacgagagctttaacgctgagcactgctccagcacagactccaaaatcgtcctcgctctgtgcgtatcaatttcaccgacaagcggaagaatcccaattccatcagtaatcggcataatcggcgcactcaattcattaatcatttctttttgcgcgtttaattgtatcatggtcacctggtgatattcttccgtaaacacttcgatgatctcatcaatgttttgattcaagatccggctccactcataaaattcctgaatgctgatgtcttgagaagaagcttcgctgaatttatgaatccattcaaacatgatgtgcctgaaagtgttaaactggccgacactttgtgtaaccgtcacttcatgaacggcacggtctctggcgcattgaagagaccaccggttgagctcatcctctacgtcttcttttctaagggattttgctacgatggtcaccaataattcatgctggtcttttaacttttgttctagtttttgctgatctttcgctgaatacagccagctgcctgttgatgtacaaactttcagccattgttgcgtgatatcttctttgtgctctgttaagtgctgatcaagagctatcatcttaatgagctacctcctgtttttgaaaaatgtacgctatatatgtataacgcgtctgcctttacacatactatgtttagattcaatgggctatagccaagcggtaaggcaatggactttgactccgtgatcgttggttcgaatccagctagcccagtttctgaacaggtgaaaaaccgaagacaagctgattcgaataaatcagcggatcttcggtttttcatcatgcagattgatgaaccgttttcttcttcgataacttcaacagttctcccgggttataaccaatcaccagctttttgttgtctactagaatcgggcgtcgcaaaagcttcggcttctcgattaaaagttccagcacctcatttaccgtcatttcttcaatgtttaaatttaaatttttgaaagtctggcttcttgtcgccaaaatttcatcaattccttctgtcgttaacgataaaatgtactttaattcttctcttgtcggggtttctctgaataagtgccgttcgttaaattcaatttgatgtgctttaagccaatgttttgtttttcggcatgacgtgcagcttggatatgagtaaaaagttaattgttgttccattcgttttttcctcctcagttaaccatctctttgtagaataactacccggatcatttttcatttaaaccatttacagaacttttttcggattatttttttaaaaacattcatacaatagaaaacacaatcaaagggacaaattccatttgtatattaataatgaaaatgtttacatttctaggtgtgatccattataataacagtcagagggactctcgggaggggataaaaatgaatcgcatgttccgggtgttaggattttggacgggaatttttgcagtcatgttttatttaggtgatatgaaagatgcttcccttttattttttggacagacgatcttatttgtgtttctatcgtatttgaacttaaccgaacgcatgtatatttatatttttggcgcttatttaacaattttcttcgccggctttacatattactcaatttttattatggtgcccggcggcggaggccattaaatgcagaaagagacaaaccttatcggtttgtctctttttttacaatgaaaacccatttaaaaacggattttggtcctgctcagtcagtacgtctgtttcaggtccatggccgcttaacaccagcgtgtgttccggaagtgtaagcagtttttcatgaatggacgtcagcagcgtctcttgattgccgcctattaaatccgtacgtcctataccgccttggaacaagacatctccggagataaccaagtctgcatctttcacgtagtaagacacactgcctggtgaatgtcccggcgtaaataatgtttccaaatgaaacggcccgatattcaactcaccgtcgccttcaattagatgatctgcaggcttagctgttacttctatccctcgcagcatgccggagccgtttaaagaagcgtccgtaagccaatttttttcattttgatgcaggtaaacagggatatcccatttttctctcacttcatcaagcgccccaatatggtcaaaatgggcatgtgtaagcaaaatggctaaaggcgtcagccctttttcttttatgtattgattgattttatgtccctcgccgcccggatcaaaaatcaggcattgatcatcattgatgagaaaatatgcgttcgcttgaatcggccctactggcattcgtctccatttcactattatcacctctttcttttttatgctcttattatgagggttttttaaaaaagattcaaacaatcgcaatgaaaacgctatcgacaaacctataaaaaacaggtagaataaaactggaaagaattgcaggtttttcaatgtaaagggggctgtgttatgttacttgtcgtgattttcggccttgtcgctcttttcgctttatggggagtcttgcgttctgttagaaataaaaatatactcgggtttttattagccggtgccaccttatttgtctttggatggtttaccgtgatgaccgtaataaacagcgggtatccaaccgcacattaaaacctgtatccgatcggatacaggtttatttttatggctgtaaatgtttattgacactttctattttgctctcaagcgtcgtttttttgtcacgcctgtcatcgatacggatattcgttgccactctgtgcaatcctttttgaaatggcgcttcgtgaattgcctgaatgactgcaaaaaggtcactgagttctccctcgatcagcgtattcatcggtgtcagctgatatttgattttcccttctgcttgatatccttctaatatcttttgcacatcggctacgtaagcactgacactgggtgtttccgtaccgattgggataatggttacatctgcgatagccatcgttattccatctccttttgatcaatgatgagttgcttcgtttcatgtgatttcaataaaataatttgctcaaaatgaaagccgtataacgcatatttcccgttcggagatatttgaatcggctccatttcccgcagagacacaagatcttttgtctctcccgatgctacattgattgctgcgagcttatatgcatcgccgctttgtttgaatgtataaaacaggcttcctgcttcatcatagtcatactccattggagccaaacttgtatatttcgcttggagcggccatttcgctgtaacaggtgatgttgattgcggcgttttaaactgatacgtcccttttcctccggaagctgatttgacagtaaaactcatttgatggaaagaatcgaagaatagaacgttatcctcaagcttctgttccgtcttagaagctgtatcgaacgtatataaaggccctgttttatcgtctcttccctcttttacataatcaaatgtatttttggatgtccaatgaatgaacggaacctgtactgggcttaagaaagattcgtcttttttagcattcacctgatatgtatggaaatcccagttttcattgaattccgtcaccatcatttgataaggatcatactgattccaagcagcttcaagctcatacgtttcgtaatctttttcgtaaagcgtctctccttctgcattaagcaaaaccactgccgtcttttggctatgtgtgatttgcagcagaatcatctgctccctcgcattgatttgaacatcaacgatttgaccatccgtttgatagagctttttcgctttgcctgtaaagatgcggtacgcaaaaagctctgttttcgtcggattagacgcagtatataatattgtgctgttattcagccagccttccaccccatccgctttttccgcggaaagcggtatgatgtcttttttctcatcttttgccgccgatgcctgtttttgctgctgatgagatggttcgcatgccgataaactaaacagcaataccgccagcagaataaaacaaactgatctcatcagcattcccctccgatcatctttattctctcatatttgcttcggcagaaaaaagaaaaagtttcagttactcatgaaaaaataacgccctccacaagataccgcttgtggcgttatatatgtgtgaaaactgctgaaacggcaaaggattttggccttttccaagttccaccgtatacccttccttaaaataatggtgaataaaccagtcacgaaatccagcatagctatctatatcccttactcccttataaatgttcccgcttaactcctcaaaatcctttatgacggcagcagattcctcaggctcaaggcctttatagccccaataaatttcttctccttgagtatgaagagccagcagtctgtcaggcggattctccgtgatcagccggtacatcgcaatagattccggctccgtaagcggagagattcccggaaaatcgcggtagctgggtgctgtcggttttcggtatttttcaatttcccataatgatggaaattgtttatttaaatcaaccccgtttatattcgccttccattcattaaaatttggacgatgttcatttagcctttcgagttcatctcttctggctcccatgacttctgatccgtttaaaacaagatcaacgccatccggattgacaagaggaacgagggataaggatgtgctgttaaacagctttatgggagaaaagccaaagaaaggcgaattgcagcataatgacatacagtattccttaaaccattttagcaggacagacgttgtaatccactcattcgcatgaaatgacgcgttcatatggaccttttttacggcatgctccccaccagccttcagctcccagataggcctgccgagtacagaacggccaatttcccggcatgagacaaacggaaaaacatcaataatcttctttatttccttttcaacagctgaatcatcatagattttctcttgctcaatccagctatctgaaagtttcagctgccgaggctgtaaaaagcgctttatgtcctgaatggtttgaagctctttgccgctatgctcctctatcacataaccagggcaatacaattgatgtttttgtgcggagcgatttgcacttttaagcaattcctcgtctatcttcagttctttcgccacattggccaaattgttcttgatctcaggtttcacagtaataaacgccatcatcatcccccttttttgttactatatgacagcgtatttaaaaaaagaaagcctcccgctcacttcaatgcgggagacattgtgattatgatgcctgatcaagcatttgtttttctttccgctttgacgaattgtccagccttttctggtcataaaatcgcaacaaatccccataaatgatttcatcagaaagtgatagctcctgttttgctttatcagcaaatgcttcacattgttttgtctcttctaacggttttcccgtctctttgtcataacacgcaccgtctgtataaacaacctgatctgtgataaagctcccgtcccggagcaccgtgaagtccagtttttcgtctgaaagcagatcgttgccgaattgaatttgatctttcgtatcaatccctaaaagattcatcagcgtcggcctgatatcaatctgcccgcctactgtttcaatggtttgcggctttttatcagtaatacccggaatatgaatgaccagcggcactttttggagctgtacctcttcaaatggggttatttcttttcctaaaaactgccccatcgcttcattatggttttctgatataccataatggtcaccatataatacaataacagagttgtcgtataacccgtcttccttcagcttttcgataaaccgtttcagcgcctcatcctgataacgcactgtcggaaaatatttatttagcgtctggctgcttgaatcatattcatcaatcaattggtcctcttcatcaagatcaaacgggaagtggttcgtcagtgtaatcagcctcgagtaaaacggctgaggcagatttttcatcagctctgaagactgctcaaaaaattctttatccttaagtccccagccgactgaattttcgtcagttacatcatacgagttaatatcaaaaaacgaatcatatccaaatgagtcgtacattaaatcacgattccaaaagctcttattattagcgtggagcaccgctgaatagtatccgctgtttttcaaaatttcaggagcggccatatattgattgcccgcattcgtaaaaaatacggcacctcgtccaagcggatacagtgaattgtccacgataaattcagaatccgaggttttcccctggcctgtttggtggtaaacattattaaagttgtagctctgttttataaagtcattcagaaaaggcgtgatttcttctccattcaatttttcattaatcacgaagctttgcgtcgactctaaggatacgagaatgacgttccttccttttgcagcgccgaataagcgtttgttggcatccttcacattagcggttacgtagttttcaatctccgtcaggctgttgctgtctgccaacgctctctgtgcggattgctttgactgaagaacgccatcgtaaatatgaaaattaaacaggctaatgtttttaacaagcatttctctgtcaaatgagcgtgtcaatagctgaggtctttccgcctcagacaagcccaggttgaagaaataaacagaagcaacgaacaaaaaataagccgcccgttcatttttcgttgagggaatgtccgattgaaaagctttttgccggatgtgaagccatattaaaaccgcaatatctacagctaataggaggtctgtcggctcaagaagtgttccgatgctgcttccgagatcacccatattgctcgtttgaaaaagaacagggattgttaagaaatcattgtaaaaacggtaaaaaaccatatttgccagcaatacaaacgtgacaagacagctcatcgcgataatgtagcgatttctgtttttgccttttaaaaacaggctgaggccaaaaataagcaacaaaaaactcaatgggttgataaacagaataaattcctgtgttagattgtcgattttaatatgaaaactggttttgtaaacagcatacgttttcagccacatcaataaaatggcaatcagcataaatgaaatcttcgaaaaaaacgtttttcgcatttcaacctcctatgcagcacgctcaaaaaaatcagtctattcccaacattctcattaacacatcaaattaaatcttaacctgagcacaacaaaaaatcaatttcatttacacaattttaacaattttgatgtttcagccattcatttttagcgatccaagcgcctccgataacgccggcatcatttccaagtgctgcgattgaaatatcagcagcttgggctgcccgcggaaacgcgcatttgcggaatgttttctcgacttttgatctcagcagttctccggctctcgatacgccgccgccaagaacgattttggatggattaagcgagcttgccaaatttccgagcaccaaaccaagatgcttggctacataatcaaccacctcaagggcaatttcatcattttcacccgccgcttcaaacacatcccgcgctgacaattgttcggttgcttttaaacgtgtcgtctttttagcatttgctattttttcttttgcaattcttacaattccggttgctgacgcaattgtttcgatacagcccgttttgccgcagttgcagggcgctccgccttcagggatgctgcaaatatggccgatttctccgccggcgccatttataccatgtacaatttcaccatttgcaatgatgccgccgccaactcctgtgccaagcgtcacgagaatgacgtcttttgcgccatcacccgctcccttccacatttccccgagcgcagcaatattcgcgtcattttctataacagctgggatgccggtttctgtctccagatggtttttcaaagcataatttttccaccctagatttactgtttcataaaccactcctgccgccatatctacagggcctggtgcacccattccgatgtatttgatgatgtgcttcggtttttgcagctcatccagcttgctgtcgattgtttttgcaattgtgacagtaatcgtgtcgccggttttatcagtcggaacttcccacttatgctgaatttcgccatattgattaataaaagcgagtttaatcgtcgttcctcccaggtcaatgcccgcaaaccatatctcgtccatttttatcaccttagcctttataaaaatctcttccgttttttgtttgttccaattcttttcgaaggacagctgccgctctggcccactgctccttttcaatcatgtggttcatgtataattcctttaattcatccagcataaactcaatttcaagctctctgtctccaaaataaacaatgtggccaaacgtttttaacagctgctgcacatcataaaatgtattcattttcctcaccatttcttgaacttaactatcataagcgtattcataaggaagcggtcagtcaagaagaaaacgctgacaaaaaagccagcttcctttccatattccacctctatgattctttattgttttcaatttgccgctgcagctccttgtagcgctgctccttcggcttcagtttcacagccgtctggatggccttttctgcttgtgcaagctcatttttttccgcatacaataacgctaaattgtaataggaagcatggtctttaggttcttttttcactgctcgttccaaaagggaaaccgcctgatcatattcgccgatttgaatatcagaaacagcaagaattttcaaaagatcggcagaggcatctttttgcgctgcttctccgttcagcaattctgttacttcttcatactttccttcctgatacagctcgcttgcctgctgaatcagcgctgactcctggtgtgaaggcgaatgcaatccgtaatataaaaatccaacagccaaagcaatcagcaaaaccgctgacaacaatctttttccaaaggctccggctttaggcaaccccagtgctgctgcagcgaaaaagccgccaatcaagccgccgatatgtcctgaattatcaatattcgaaaccgcaaaaccaaagcccagattgatgataataatgacaataatattggttcctatagttcttaaaaacatttttcgattagacaaagcaacatacagtaatgcacctaagcatccgaatatggctcctgatgcccctgccgaaggatacgggctgaacacaaaactcgcaatcgaacccgtaatgccagcagccagataaatcagcaaaaatctccccgatccatacatccgctcaaccgctgtaccaaccgaccataaagccagcgtattaaaagctaaatgcgctatgccgatgtgaagcacgatcggtgtcagaagccgccaccattctccttgtgcaatcaggctgttttcttttgctccaaaagccaccagtgtctccgtattagtgctgcctccgtttatttcgagcaagaaaaacatcaggatctgaagcgcaataaataaatatgtaaaagtcggttttccgttttgaaaaaccgccgcttcagtttttctctgttcttcttgtttcagcactagcgaaaggaagcgttctcgcgccatttgcgcgttttcaaacgaagcgtgttcctctgaacaatcttctgtacgaaatgatggaaaaaccgcttgaagatcatctcgaagcatcgttcctctaacgatcgccggctcaactgacacagttcccttctcaaaagttttttttgcaatctcttcccagtcatcaacaggggcttccgttgaaaaaaacacattcagcagcttcatccttcgtctgcccaattgatgtctgactcgttctactcgttcggcctgctcttcgatgtctctaaccatttcttgacggaaatcaagatcgtgcttataaagacgaactagatcatgagaggacttgtccggcgcttccagccatatttcatctgactcaccggcttgtatgacgccatacccgctattcaccaggtgcgccgcaattttccaatatgtatactccagcaaaaacatgtttaccgctccaatagtttttttttcattataacagctggcgctccgaaacgcctactgaaagcaaaaaatcccgtttttcacgggattttagaaagcttgctgtataaacttattgcggataaatggaattcttaaaaacaaatggataaaagaccgcctgattcctggctggctgagtacagtattcataagacggtagcgattttgataaaacatgacggcagaaaccgcgaaaatggcatatatcaaaagttttttcatgatatccctcctgccaatagggtttgttattctgccttatttattctcgaataagggacaggaaagttatgaaaaacaagaaataatccgatcctctgttatcagcttatgtaccgggatgtcatgcggcaaacggggtacgtgcgcaaacagctggcactccaaaagcaaagagactgtctccccttcatattcacttaaatagcgatcataatagccgcctccaaagccgaccctaaacccgttaacatcaaaacaaacacctggaacgatcaccaagtcaatttgtgatgggtttacttcttttgttttttcaattaccggctcgagcagtccggcgtaaacggtttcgagctgatcatcggtcttatatgtccgaaattgcattttcttcgtgtccggatggcattttgggatgcaaacttgtttcccttcttcccaagcctgctcaatgacaggacgcgtcggtatctctaatcctctggagatggtgaccgcaatggtgccggcattttgccactccggcagagaaaacaagtacttatacatacgttccgttttttgaagcagatcttcatttgataaagcagacagtgcctccagcgtcttttttcttaattgtgatttcatctctcatccccctcggaatagaaaaaaagccagaacctttttcaaagctctggcttttttcttacacctcaaacagcaaagctgttattttgtttcacggtgtaacgtagattttttatcacgtgggcaatattttttaaattcaacgcggtctggattgttgcgtttgttctttttagaaatatagttacgctcaccacattcagtgcaagccaaagtaatattaacgcgcattattttccctccaaactaaaatcatttacttattcagacttatatataataccactataatggacggaatgctaggctgtttttcaatgaattgctgaattattgaagatacgctcataaagctgcaaatatgatgacataatgagtcgggggtggtggagcttgaacacttgttgtctgccagcttcttttatccggcgggctttttcccggtcttttaaaaagctgtccagcagatcagccgcttcctgtacgagcgtaaaattagcgatgattgccgttttgtcatgaacggcataatcacaaaaaccacccgactgagaaacgacagtcagcacaccttgttccatgctttcttgcgcggcaagcccaaacggttcataagaactagggaaaacagccatttcacattgagacagtaacgttctgatgtctttcctattgagaaacggcaggaacatgacgcgatccttcaggttatatgccgcagctaatttctcatagcaggacagagacggcccctccccagccagcactagatagaggtctggctgacgctgcttcaagatggcaaacacctttaacagctgcgaaaatcctttttccggaacgaaccttccatatgaaaagagaaatcttctatttatgcttctttggattttccccttctcttcctccatagatgcagggcttgggataacggttatttttttatgtgctgccttattaagagaccgcttcataaatgtgcttaatacgatcaatgcatcagcggattctataaggagccgttcggtcttgagcctgtatgggtgtggggcttctcggcacaccttcttcctttctctttcaagaccgtggattgtcgcagtaagcggaaggccaagccgttgtttcaaatactgggcagcaggggcagttgtgtcatcatgggcatgaatcagatcaaagcgtttattgtgtgataacacatggcgaaccattgtaaagttagcatcagctatgtaatcttcaaacttcgcatacgaaaacagctgcccgctcggagtaaaaaccgtaatgttgatatgagggtttaaataggaaatgaggcggtttaaatggacacctagcccgcttttcggctcatcgggatgttcgggtgaaagcatgagaatgttcaccgttctctctcccctctcccataacaggtgtatgcagaaaattgctcctcccacctggtgtgcgcttcctcaatctgaaagctgtttatatgacgaatcccattttcatcaagatagatgtcgtctgtatcggcaagcttgagagagacattcattgaattcacaatactgtattcagcccgatatacagcatcaccagccgtctgtctaatcgtccattcgcctttatcatacgttgtgcgttttgtcctgacagcttcaatgtcttttcttttgatgacaatccgcaattcttttatcatatcctgcgttttttcgaaaaggacagcttcagccagccgcattgtttcttctgagatttcccagcttacggtcaaggtgtgagcgttttgaatgattatgtcgaatgtgtccctaaaaaaggaaagcttatgtcgtatattatagggaaatgggtgtttatccatggactcttaacattctcctttccaatcgttcacttcgtgttcctattaaaccattacataaagaagaagcaaagaaagatttctcgacaaaatctcgtttttttcgcgaattcctttagaaactattggttttatggtataaaaaagaaggataaaaaaagaatagaaggtgatgaaacgtggaaattgctattattgcgttgtttatcgtcagtatagcgctaattgcattctcatattctcaaagagacccgatgaaagatgtagaacaggagctcgaaacactgcagctttctgcgatgcaggaaatttacaagctcaaaaagaaaatgacagtgcttgaggaagaattactggaaacaaaccttgtcattcgcaaatcaaagcagaacgacatcaatcaaaaaatcgctaaacaaatactttctaaatataataacggtatgtcagctgaagcgattgctaaagctgagcatgtatcagtggaagacgtgaatacgattatcaaagataatgagaaggtgctcgtatgacaaaacggggcattcaggcatttgctggcggcatcattttagcgacagccgttcttgcagctgttttttatctgactgacgaagatcaggccgctgctgtaaaagataataaaacagtaactgaacaagacgtgaacaattaccttgattctaaaaaaatggtttctgtgaaccgtgatgaatatcaaaaacttcttgattcaaaagagaaatcgttgaccgatgacagcagctcagacacgaaaacagacaaagtcaaaacgtacaagctcaaaattaaagatggcatgagcactgcggatgtatctgctattcttgaaaaagagggcattatctcttcggctcaagactttaatgactatgtcattgatgccggctatcacaaagaaattcgtgccggcgagtttaaagtaaaatcagacatgagtttcaaaaagatcgtaaaaacgttaacacgataaaaaaacaggctgactcagcctgttttttttcatccaaactttcctgaaatgtaatcgagagttctttggtccttcgggttagagaacattttattcgtattgtcgcattcaacaagctcgcccatgtagaaaaaggcggtttgatcagaaacccttgctgcctgctgcatgttatgcgtgacaatgacaattgtgtatttatttttcagctctagaatgagttcttcaatttttctcgttgagattggatctagtgcagatgtcggttcatccatcagcaaaatatcaggattggtcgcaagtgctctggcgatgcaaagacgctgctgctggccccctgacagcgaaagagcggacgtatgcaatcgatccttcacctcatcccataacgccacgtcttttaatgacttttccacaatttcctgaagcttcttcttatttttggtgccgtggactctcggtccgtaagccacattatcaaaaatagattgcggaaacggattccctttttggaataccattccgatattttttcgcaaatccacgatgtccactttatcctttaaaatgttgctgccattatagttcagctcacctgcaagctttacattcggcgtcatttgaatcattaaattcaatgtcttgataaaggtcgatttcccgcatccggatggcccgataatcgccgtaacctcattttcataaatgctcaaattgatattttttaaagcatgatgctgtccataccataagttcattccattgacttgatagacttcctgtttcattacagcttcggtagcaatactcattgccgccctcctatccgaatttcccgttaatataatcctctgtcttttgctttttcggactcgtgaaaatctgttcggtctgtccgtattctacaagctcgccgtttaaaaagaatgccgtccggtcagaaacccgcagagcctgctgcatattgtgcgtgacaataataattgagtattctcttttcaatcctgtaattaattcctctattttcgcatttgaaatcggatcaagcgctgaagctggttcatcaagcagaagaacagccggcttcatcgcaagcgttctcgcgatgcataaacgctgctgctggccgccggataacgagagtgcggatgaatgtaaacgatccttcacctcatcccagagggccgcttttgttaaactttcttccacaatttcatctaaaacagctttattccgctctccggcatatttcaatgcatgtgtgatattcgcatagatcgatttcggaaatggatttggtttttgaaaaaccattccgatttctcttctcaagctgacaacgttaatattgccgcccaatatatttaatccttcataaaggatttcaccttccgctcttgcagatggaattaaatcgttcattcggttaatatttctcaaaaaagtagattttccgcatcccgacggcccaattaaagcagtcaccgcatttttttcaatatccatgtttacatgatgaacggcttgtttatttccgtaaaaaatggacagatctttgacctcaagcacgtggttctgcttcggaacaataacagctcgctcaggtttttcttttaccatttgttcagacatgcttttcgcctctttccgttctaatttgccgtaagctttttgtagatcatcgtgccaagccatctcgccgcgagattaaacacaagaacagaaatcaccagcacggcagaaccaccgttggcaatcgcttcagcatccggaatcattccttgtgtattgacgttccaaatgtggaccgcaagtgtttcagcgggcctgaaaatattaagcggtgatgtttccgaaaacgggttccactccgtaaaattaagacgcggtgttgtcaggcctgccgtaaataataatgcggccgcttccccgaacacccttcctgacgctaaaattgctcctgtgataatagaaggaatcgcacttggaattaaaaccgtttttacggtatgccagcgtgatacacctaaagcgagagaggcttccttcagatctttagggactgaacgtatcgcgtcttctgtcacacgcaccatgacaggaaggttaaaaacagttaacgcaagcgctccgcctatgatcgtatatccccagcctgttaagttgacaaacatcaataatccaaacattccaatgacaatagacggaagagatgaaagcacctctatacatgttctgatgaagtcagttactttgttattaggcgcgtattcagccatgaagaccccgccgcccacaccgagcgggattgtaatcagcattgtaataaacaaaatataaaaggagttaaacagctgatctcgtatgcctcctccagctgcaatggcgctcgactttgttgtaataaattgaaaactgagctgagaaacaccgtttataataatataggaaaacaaacctactaaaatggcagcgataatggctgcacacaaaccaaacattccggtcgccagtttatctgttattttgcggttcattacactttcctcctagatgacaagtagcgaataagcaggatgaacaagaatgacatcaccagaagcacaagccccattgaccacagcgtattgttttcaacacttccgtatgtggtgtggcccatattcagcgtgatgatcgttgtcagcgttcccgcagtgtcaaacaggctttccggcaatactcttgtatttccaatgaccatctgaacagccaaagcttcaccgaacgcccgagccatgcctaacacaacagctgtcatcaatgttggaaaagctgcaggcacaagtacttttctgatcgtctgccatcttgtggccccaagcgcgtaagaaccctctcgtaaactcttcggaagagaagccattgcatcagcagaaatcgatgtgatcgtcggcagaatcatgacggaaaggacaatcgttcccgccaataaactgtgccctgttccgctcgatttgaactgggcgataaacggcaccaatactgtaagacctatgaatccataaacaacagatggaataccgactaaaagctcaatcaccggctgcagcactttctttccccaattcggggcaatctctgtcatgaaaatcgcacctgcaatgccaagcggcgcagcgattagagcagaaagaatcgttactgcaaatgagccaaaaataaatggcagcactccgtatttcggatcagtatctgtaggattccaatttaagctcgttaagaattcaattgggcttacaccatttacaagaaaagattgcagccccttcacgccgaggaaaatggtgatcgcaacagatgccgcaatcataatcagggcacatgctgtcacaatcattcttccccgaacttcatccaattgccgattttgccttgagctgattaaacgctcgctcacagacatattttctctattgtttatcattgttttacactcctatgaatgtgttaagaggagaaacggttgtccccgcactcctctttttattaagatcagctttgcttccctttggcatcgcgtgtcactttcatatcagtaaccggaatgtagccttggtcagtaacaatgcttttttgaatgtcttcactctttagataatcaagaaattctttagctaaacctgtcgcttcaccttttgtataagaatgctgataagcccagatcggatactcgccagttgctacatttttcgcttcaggtttaacaccgtcaatagatagagcagttactttgtcatctgttaaatatgagaatgcaagatatccaatcgctcccggagtatcagcaatgatctttttcaccgtgttggaggaatcttcagtaatgccttctgcaggctccgctccgtcaagcgcatatttcacaaatgtagcacgtgtgccggaagaatcagggcggtttacaagtgtaatcttttggtctttgccgccgagctctttccagtttttgattttgccagtgaagatttttttcaattcatcttttgaaatatccttcacaccagcatcagggtttacagctgctgccataccaactacagcgacttgatgatcgacaagcgcttttgcatcgataccttctttttcttcagcaaaaacgtctgaattcccgatctgaacagctccttcagagacttgagaaagccctgttccagaaccgccagcttgtacctgtatatcagcatcagggttttcttccataaatttttccgcggctgcaagtactagtggctgcattgccgatgaaccagaaatggttaaagaacctgatgccttttcttctccttttgcagaatcgctattcgattttttactttctcctgcatttccgcatgcagctgcaatcatcataaaagcagccatcagaagcataagcaccaatttgttttttttcatttcctgaattccccctgcgtataatgtgtaatttgtcctacacgtatagagtaaaggttctatgtaaaaagggtttgaaccgaatgttaaggttttgtaaatcagtgcgtttttttgtataaaaaaaacgcccacatcatgtgagcgtttctttttagttatcagaagacgttgtgttttctgcattttcttcgattttgtttttattcttttgctgagtatcttctttgtcctgcttcgatttcagctcaaaatatttatccattacttccctgccgatttcgtttgtaatggtatatttagcgctgtaatcaatataagcccaagggactactacagagatcgcaatctcaggattatcagccggtgcataggcaacaagtgtcgtattataagtcgatgttcctgtttttgatttatcaggtccatcatagaacgattgtgctgttcctgttttaccggcaggctgatatgacgctgaagcaaattgactggcagctgtcccttttgtcatcacccgtctgaatccggcctgaacctctttaatatattcactcttcatgtcgattttattcagcacttccggctgaacggattgtacgacagcaccgatccctcttttagcatcaggttctctgacttcctttacaagctgaggctttaagcgatatccgccgtttgcaatcgttgatacgtattgcgcgagttccagcggtgtatacgtgtcgtattggccgatcgcatagtcaagcaagaatcccgtcaatctgtctgttcctttatagcctgtcatttcattcggaagatcaattccagttttgacacccagtccaaattggctgaagtaattacggaacgtatcaaaggccgtcgtatcaatcggtaaagcctggtgcggtttatattcaccttttccgagcgcgatcgcagttttaaacataaatacgttggaagactgctctaaggctctttgaatattgaccggtcctaagttagtccatgactttttaccgcgtttatcctgactgccgatatacaatggttcatcctgaaaaactgtattcagattgatagctccggtttgaaggcctgtcaagactgttgcgcctttgactgctgaacccatagcgtaagatgacgtcattgtacctaaagcgtaatcatcaattttatatttcccattttcttgtttaatctgcttgcccgccattgaaagcacttcaccgtttcttgggtccatcatgacaacgaatgcccggtctaacaattgcgtgcttggtcttgctttagcagatttgaggttcttctcaatgattttttccacttctttttgcaaatcaatgtcaatcgtaagcacgagatccttaccggctttgccttcagataccgtttttgttcccgtgacattgccgtttgaatctgtgatattttcgactttggctttttgtccctgcagaaggctttcatattggtattccaaatagctttttccgaccctgtcattacggctgtagccaagcgacagataatggtcgagcaagttggacggcaatccttcattagagctggaaacacttccgagcactgagcgaagaaggtttttatacggatattcacgttcccaatcggacgtgacatcaacacctggcagttcgtctaaatgttcacttaccactgccatttccttcgctgatacatcttcgtttttgatatattgaggggtcaatgcatagcccgaatccatctgtcttttgatagcgaggatctgcatatctttatccgtcaattcattcaactgcttatcagtaatccgttttagctgaagctggtataaatcgtcatcggatatttttttgtcttcaacctgctgtctttctttagagctaatgagctttttcgcttctttcggtctagtcaaaatccaataatcttttttatcccgttctgttactttttttgtatcgactttgatcatgtcagacagcttttttgcgatctttaagcgctgttcttgcgtggtcgatttagatctcgtgtatgtgattgcatttaaagccttatttgtcacaatggcattaaagtttcgatcataaattttcccgcgcggtaccgctgagctgacttcactttgttcttgcttattcgcttggtttttgtaatcatcaccttgcacgatctgcttgatgcccagttccacaataatccaggtaaatataacaaaggcagctaaaaataaaatattcagccggatcggaagcgacttctttttctctttatgattttgcttttttggtttatttctcctcataacatcaccttttctatttacagaaagaaaagacactcaagtaagagtgccagttttcattttaaaggttttttcgacttttttctacagataacccctttttggcaaaaaaattatctctcgccttttaacagggtcggttctgttacccgtttttggccgtcttcttccatggtttcattttccccttctttctccttaaaacggatatccttgacaaagtaataaatcaaaggatgtcctatacccaatatcgcaagtgacaaaggaattcccacatcctctttcagaagggccacaatcaggagaaagcacaaaatggaaacaattctgccggcgttcaagaacatttctctaagcacgatatattcaattcttgcttttctggcatgcctcgcgcgccctatcacatcatatgtaagtgatacatatggcacaagcaacagaggatagccgatggcaataaaaacgccatacgttaataatgtcgaaaagctcatatggaacagaatcaaaaacagcgcgccatacaaaataagtccgcccagcaaaatcgatttttttctcgcctttttcttaatcagcctggatgcaaagtagtaggcaaagaaggaaacagctgaattgacaagaccgaatgtaccgagagcaagttcgctgtttgtctcaataaatacaaacacactgattaaaaagacaaaaatcccttctctcaaaccctgaaaaaaatgcgcattcgtgattctccgccaattcatattgctatggcgctctccaaatactttgctcagcataaaacggccctttgattctctccgttttaagaaaaagctcatcacgacagccagggcaaataaactgagggagagactgaaaatcactgtataacccgtattattttcaagccttgagatcacgaatccggctacaatcgggccgatcattcctgcagaggaagacagaatgcccataaacccgttgaaaaagtctcgtgtatccggctctgttatttcaaaggtcagtacgttaaacgctagccaataaaagccatagccaactccgagcaccgcgccgattagcacgaggcggctggccgccgtttctccggctaaaagcacacttaaataaaaggcagctaaaaaaatgacgccgaaccttaaaatgaataccctgtctatttttttggctaaccgtccagccaaataaaaggttatcggctgcattgtcacaatggataaattatatatcgccaaatcaataaatttccctgactgcttccaaagatacacattaacaaatgtattggacagtgcaattcccagcgagtaaagcccgccaatggtcagcagaaagagtaaccctttgtttacgtctacatcgcctatcactttttttagtttgctcattactgactcccctttactatcccttagtctgtctcactcaaaccgagatatgtaaaaagaagacataaaaaaacaaggtcccataatgaggaccttgtttgtgccattattttgcttcgctgtatagacgagccacttcgtcccagtttacaacattccagaaagctgaaatgtaatcaggacggcggttttgatagttaaggtagtaagcatgctcccaaacgtcaagacctaagataggcgttttgccttctgaaagcggagaatcttggtttggcgtgcttgtgatttcaagtttaccgttgttcacaacaagccatgcccagccagaaccgaagcgtccagctgctgctgctgcgaattgctctttgaatttgtcaaagcttccaaatacactgttaatctcttcagcaagcgcgccagtcggttcgcctccgccgtttggagataaaagtgtccagaataatttgtggttcgcgtgtccgccgccgttgttgcggactgcagtgcggatgttttcaggaacagaatcaagatctgcaacaagctcttcaactgatttgttggcaagagcagtgtttccttcaaccgctttgtttaaatttgtcacgtatgtgttgtggtgtttcgtatggtgaatagtcatagtttccttgtcgatatgcggttctaaagcatcgtacgcataaggtaattctggaagttcgtaagccatgataattcctccttagtatatatgtactgaaatgccgcttcacagcgagcctttcttcattcaatgtaacaaaagaatgctttgtaatcaatgaaaaagctcacgatttggctcatttcagcggacatatttcactttaaccgataatctgccccattaaacctgccgccagcatttcttataggaccgtccataaaaagtatccgatcatcaaaagctgtatgatgccctttgcaataacccctgttaaaaaaccaatgagtgagccgaggccaattttaaacgctgactttaagtccttctgatgaacgataagttctgcgcaaacagccccgataaacggccccaatatgatccctgcaaccggaatgacaaaaggcccgattaataaaccgatcgtgcttccccatatggcagctttgcttcctccgaacctttttactccaagcagattcgacacgtaatctgctgcgaataatactgcggcaaaaactgcctcaacaagccagaacatataagaatacggactgaatgaaaataaaaatccgtacaatacaaatccggcaacaataaatactacgctcggaataacaggatacaccagcccgataaaggcaatgataaaaaccgctgcaatcaacagccaatacaacatatccatagcttccatcctcccattttactctgtcttcttcatgtcttccttgtattcacacgcatgcaacgatacaataagcaacatatattagtttagctaggaagtgaagatagtgaatgtgtttcagcttttcattaaaagtacatactctccccgtgatattgcaaaaacaagatttcaaggaatcggaaaagcgattctttatgtatttttgctctctgtcctgtttgcaatccctaccgcttattatgtaagtacagggaccgtaaaatcaatgaacggctttaaaactgttttaaacaaagatttccctgatttcacaatttcaaacggcaaacttcaaacggatgagaaaaaagccacggaatctcaagcaaatggtttcgttatcgtgttcgatccgacagactcctatggcactgaacaaattgaagcaaagcaaaacgcgatcggcatccttcagaacaaatttgttttggccattgacggacaagcccaagaaatgtcttactcaatgatgccatcagagttacagaaaaaagatgtcattgcagggttaaaccaaaataaagcgatgattgtaactgttctctcagctcttatttttctcgtaacagcagcgggaaaatttattgaagtatcgtttttagcgcttatcgggttaatcattaagaattcgcagaaaaaacatttatcctatcatcagctctggaagctttctgcttattccatcaccctttcaactgtattctttacaatcatgcgggcattagaagcaaccgtaccaagtgaatttttgctgaactggtttgtcaattttgtcatcctgtttctcgttttaaaagagattccgtccaaaaaagctgctgtataaaccgaggctgcattcgcagtctcttttcttttgtcatgaatcgaaatggacaagcatactatggtataaaatttcgtatgcgggaggaaaagcgatgaagcgtctcaccttagtatgcagcattgtttttatactttttattcttttttatgaccttaaaattggaaccatacccattcaggacctccctgtctatgaagcatcagcaaaaacggctgtacaagaaccggcttataaaacggtgaaggtaaagccgggtgatacggttatgtcgatagtcggatcagcaggttctccggatgacattgtaaaggattttgaagcactgaatccaaaagtgaaagctaacgccattcaagcgggaacagcgtataaattcccggtctatccttaatttaacgttaatttcttgtcagttcggcgaagacactgttacaatgtaatttgtaaaataaattcacataaaccatactagaattgttatatctagaagcggcaactacaattaaggagcgattgcaagtgagtgaaatcacacatcgtacaaaaacgcgtcccgtcaaagtgggacctttaacaataggcggcaacaatgaagttgtcatccaaagcatgacaacaacgaaaacacatgatgtagaagcaacggttgcggaaattaaccgtttggctgaagccggatgccaaatcgttcgggtagcatgtccggatgaacgggcagcaaacgccattgcggatattaaaaagcgcatttccattcctctcgttgttgacatacatttcgattataaacttgcgttgaaagccattgaaggcggcgcagataaaatccgaatcaaccccggcaacatcggccggcgcgaaaaagttgaagcggttgttaaagctgccaaagacaaaggcattccgatcagaatcggagtaaacgccggttcattggaaaaacgcattttagaaaaatacggttatccgactgccgatggaatggtagaaagcgcacttcatcacattaaaattcttgaggatcttgattttcacgatattattgtcagcatgaaggcctctgacgtgaaccttgcaatcgaggcttatgaaaaagcggcgaaagcgtttgactacccgcttcacctcgggatcaccgagtcaggaacgctgtttgccggcacagtaaagagcgcagcaggactcggcgccattttaagcaaaggcattgggaacaccatgcgcatttcactaagcgcagatcctgtagaagaggtaaaagtagcaagggagcttctgaaatctttcggcttagcctccaatgctgccacgctcatctcatgtccgacttgcggccgtattgagattgatctaatcagcattgccaatgaagtggaagagtatatttctaagataaaagcgccgattaaagttgctgttctcggctgcgctgtaaacggacctggtgaagcgagagaagctgatatcggaatcgccggcgcacgcggtgaaggactgctgttccggaaagggaaaattgtccgtaaggttccagaggaaacgatggtagaagaactcaaaaaagaaattgacattcttgctgaggaacactacgcaaaacttgaagctgaaaaagcaaaattaaaagaagaaacacaaaaagcttgacgggaacccgtcaagcttttttgtgttagaaaaatggaataataaatattccaagcactaatgaaacgacaccgatacccattgcccaggctccaaggccttgagcacctcttcttcttgcgatatagccgacaataataccggcagctcccaataaaacaggcagtacaaacaatgaaataatggacaaggctaaagcgatatatcctattccccgtccttcattgacattgccgccgctgcgatcattgtcttggtcattgctgcggtcagcagcacgataaggctctgcgatttcagcagctgtttcctcaaaaaaaccgtcattgtcgcgggtaatatttgtcccttcagatccatgatcaacatagtaactgttgttatcacgcttttcgtaatcgtttgccaccttcaattcccccttctgttttattaaaggagcttttatagtttgatccattttgcctgattcatgtttgctaaacttttctgttaatgtcaattgtttatgttacacttgaagggatgaaactgaaggagtgtgggcatgttacgcttaggaatagatattgacggcacaatcacggctcaggatacattcgtcccttatttgaaccgttcgtttaatctttccatttcattaaacgatatgacggattatgatttaacaaagctgttaaacattacccaggaagaattttgggattggatgaatcaaaatgaagcgatcatatataaggaagcattgcttgcacagcatgcgaaacagtcacttgattttctcaaagaggagcacaagcttatttatattacagcgagacggactcatttaactgatattacctatgaatggtttgacagacaaaacattcattatgaccacatcgaactcgttggcggtcatcacaaagttgaagcggtcaagaatcataacatcgacctgttttttgaggatcatcacgggaacgccatgatgattgcgaaagaagccgggataccggtgattttgttcaattccccttataatcagcttccgattgattcaaacatcatcagagtaaacaactggctagaagccgttcaatggatgaacaacaataagcatcacttaatacgtgtcaataactgaaaaaggagcccaaaccgggcccctttttcatatatacgcattttacgcagtagtgttttcttggttttccgctgtacaatcagggcatgtgccataaatctcaaatttatgcccgctgacctgatagccatccaaatcatcacaaagcttgtccatcggacatgattcaatttcctttgttttgccgcaggcaagacaaataaaatgatggtggtgatgggtgaatgaacacttaaatcggaagagcttttcaccggacagctcagttgtttccaaaatcccaagttcttcatataaagaaagatttctgtagattgtatcaaagcttaagcctggataatcatcattcagtgcagacagtacgtttttagcggtaagatatctgtctgaatcagcaaaaagctgcagcatatcctcccgtttgtttgtatatttatatccgttttcttttaataggttcagcgcttcttggacgttcatgaagggtcccccttttcgctttgcttaagaacgtatcacatgtatgaaaaagaaaatggcagctgtctgtccagcaagccattttctttactgcagataaaattatacccataaaatgaataaaagtaaatgaaagcctagtggattgcgtttttgaattttccgcctctcgtttcatgagtattcataattgttatgaatgcattttgatcaacttcaaacacgatcgatttgagctttgtcacttccagccttgtgacaaccgcgtaaattacgtctttttcttcgtccgtatatccgcctttccccttcagcttcgttgtgccccgaccgagacggtgcaaaatcgcgtcggaaatctcatcatactgctcagacacaataatgacagcttttgtttcatcaagcccttggatcacggcatcaatcgttttcatcgcaatataataagtcatgaatgagtacatcgcttgctcaggaccgaacacaaaaactgcccaaatgaaaatgaacacattgatgaacataacgaactcacctactgaaaacgggagttttttggtcagcaaaataccgagaatttctgtaccatccattgaacctccgtttcgaataacaagcccgacgccaaagccgagtaaaagacctccgaacacagtagccaaaataggctgggttgtaatggcttctacatggtgaagtgaggattcaataacggcaagcccgacaatccctataaacgtagagactagaaaggtcttaccgatatatttatatccgaagatcataaaaggaatatttaatatgacaacgaaaaaagcgaaattgagaaaggggtttgacataaagaggtggtctaaaataagtgatacaccgataatcccgccatcaataaaatcattggggattaaaaataattcaatacttacagccgcagatgcagctcctaccagaatcataaagaccctgaaaataaaatgggtaaatgtttctttcttatgttgttttgttggggtcataaaatctcctttcctgcaataactattttaaatacattataaatctattttaccattaaacactgacacattttactgatttgcccatacattaagtctggaggtggaatgaccaatgattttatttcaaagaattattttacagcggcttaatcaggctactgctgatgatttgctgaagtactcaaaacaatacggaatcagcttaacaagatcgcaggccgttgaagtagcgaacttgttatacgggaaaaatgtaaacatctttaatgagagtgaacgaatgcggctgttgaaacaagtagagacgattacatcgaaagaaacagctcaaacagttaatgaactattcaaacaatttacaagctaaaaaatgggggtgttatcccccattttttattgctgtaaaatcttttcgagcaatgtatcatcaaattgtttttctttcagcatgtcaatctcaaaacggtatggcggttttttgttctttttatcttcaccgacatatggtgtttcaagaatttttggaatgtcttttaactgctcatggtgaacaacatattgcagtgcgtcaaaacctatttcaccaaagccaatattttcatggcggtcttttctcgcacctttgacatttttgctgtcattgatatgaagcactttaatacggtcaatgccaatgactttatcgaactcattcagcactccgtcaaagtcttcgacaatgttatacccggcatcatgtgtatggcacgtgtcaaagcacactgacagctgctcattgtgtgtaacgccttcgataatctgtgcaagctcctcaaagcttctgccgcattctgatccttttccagccattgtttctaatgcaatctggacattttgattcggatcaatcacttcatttaagccttcaataatttttttgatgccggcttcagctcctgcccctacgtgagcgccaggatgaaggacaatttgcttcgctccgatggccgctgtccgttcaatttctgaacgaagaaaatcaacacccagctcaaaagtggacggatttgtcgtgttgccaatattaataatataaggcgcgtgtacgataatctcgtcaatgccgttttcttgcatatgtgcccggcctgcttctatatttaagtcttcaattttctttcggcgtgtattttgcggtgcgcctgtataaatcataaacgtattcgccccataagagactgcttcctggcttgctgccagaagcatatgttttccgctcatagagacgtgtgagcctattctcagcaacaggttcccctactttcttttcttagattggtttcttctctgttttttcttgattttctccatctcatagctcattttctttttatacccaggcttaaccttcttcggctttttcacgagacgatgagcaatttcatccgcttcattcggcgtttttttacgctttttgcggcgctgacggtcatcgccttttttccattcgcccttttcaagctctaagtaatcaaattcgatgcccattttttcaagtcttactaatgcatcctcatcagtaagctcataaatggtcatcgcttgtcctgatgagccggcacgagccgttctgcccacacggtgaacatagaaatcgagatcatccggcagctcatagttgataacatggctgacacctttaatatcaatacctcttgcggcaaggtcagttgcaatgatatatgtgaattccaaatcattgatctgcttcatgacttttttccgctcacgtggtgttaatccgccgtgcagcaagccgattttcatgcctttgccagtcagatactgggcaatatggtcagccgtatttttcgtgttggcaaacacaatccccaggtatggattcagatgcgacatgatgtcaaaaaggagcttgtccttgtcacgatgtttcgaaggaatgaggatatgctcgattttcgcagcagtcacctgttttggctccacatgggcgtatttcggattttccatgtatttcttcaagaatggtttcagcttttccggtatggtcgctgagaacacaagcatttgcagatcctcaggcatgcgggaaccgatgtaatctacatctgcaagaaatcccatgtccagcattaaatccgcttcatcaataacaagagattccgctttatgaacacttaacgcctgttctttgattaagtcagcaatccgtccgggtgtaccgacaacaagatgcggctgtattttcaatttatcaattgatttttgtttatcagtgcctccgataaaacatttcgagcgaatctgactgccttcctcaccctgcgtgattttaagcgcttcctgataaatctggttggctagctctcttgtcggagccgtaatgactacctgaacgacatccttagcaggatcgattttgtttaataaaggcagtaaataagcgtgagtctttccagtacccgtctgagactggccgatgacgctttctttttttaacactgcaggaatcagccttttctggatatcagtcggttcgtaaaaaccaaggcgatgtactgcatctataataaatggtttcaattcataaagttcaaatttcgtttctttcatttttcccagctccttaaagcggcacattatgtgtccatcatcacattatacccgattttgcttaaaaacaccacgtttgcaaggcgtttgttttattcagttatgtaaagcaaataccgcagcccatgcatattctaatagcagagagagctgaaaggaggtacaagtatgttttcaccgcagcagccaatgagaaattacccacagcccggaccgccccgccccatgccaaatcagcgaatgatgggcagaagaccgcctaatatgcgaggactttcatttggagcacagcagcaaggttttcagcaagccggacaatttcttcctcaggcaaatgccggagcgagaaatggtgcaggtgcaggcggaggcttaaaaggaatgctgtcaaggttcctacccggcggaggaggcgctggcagtgccggagttccaggagttccaggagcaggtgccgcagcgagcggaggtgctggcctgcaaggcattcaaaatatcgccaatcctgcatcattatccagtatgcttggaaatgtgcaaaaagtactcggcatggcgcagcaagtcacccctatgatccagcagtacggcccattagtccgcaatctgccagcaatgatgaagctgtacagccaattaagtaaaagtgatgatactgagacagaggccaatgaggaaagtgaaaaacaatccgtttcagaagaatcatcagaaaaagaaaaagagactgaaacaaaaacctcagatgggaacaaaaaatcaaaaccaaaaagttcttctctcccaaaaaaatctaaaacaactgacaataaagaacaagaatcaaaaacatctgcctcgaagaaaaaggaagctgcctctcctgctccgaaaagaacatcaggcagttcaaaaccgagattatatatttaacattctttgatatctgaagtgagattggctataatgagatcagaagaatgcaagaatagagccgtttgattacggctttttatattgcctttactcacttcagtattggaggacaaccgaaaatggacgtaattaaaatttcaccgcgcggctattgctatggtgttgttgatgctatggtcattgccaaaaatgcgtcactagataaaagcttgccaagacccatctatatactcgggatgattgttcataataaacacgtcactgatgcgtttgaagaggaagggatttttacattggacggctctaaccgtctggacatcttaaagcaggttgacaaaggaactgtcattttcactgcgcacggtgtttctcccgaagtcagaagaatcgcagaagaaaaagggttagtcgcaattgatgctacatgtccggatgtgacgaaaactcataatctaatcttagagatgaaagaaaaaggatatcacgtaatctatatcggcaaaaaagggcatccagagcctgagggagccgttggcgtagcgccggagatcgttcacttagttgaaacagaagaagatgtaaagaaccttgatatccaagcagagaagttaatcgtgacgaatcaaacaacaatgtctcaatgggatgtccacgacattatggagcttgtcaaagaaaaatatcctcatgtcgaatatcaccaagagatttgcctcgctactcaagtgcggcaggaagctgtatcagagcaggcaaaaaaagcggacttaacaatcgttgtcggagacccgaaaagcaacaattcaaataggcttgctcaagtgtcagaggaaatagccgggacaaaagcataccggatcggcgacttaagcgaattgaagctcgaatggctgaaaggcgttaataccgttgcagttacagcgggagcttccacaccgacgccgatcacaaaagaagtcattcgctttttagaacagtttgatcacgaagatccatcaacttggacaactgaacataatataccgctcaaaaaaatacttccaaaagtaaaagcaaaaaactgaggctgtaaaagcctcagtttttttatagaaatgtaaatggatttgtatctgtttcagaaacaaagatattcacgtcaaactttttatcattacacattgatgtcagctttctcgtgacgccttctttcatgattttttccgcatagtgtcccggatcaaccacatttaggccaagcatcatggcatcatgggccacatggaagtataaatcccctgtgacgtaaacatcggctccctttcgttttgcatgatgaatatacttgtttccatctcccccaagaacagctacctttttcaccatgctgtcagcatcccccaccattctgacaccattgacgtcaagcttgtctttcacaaataaagcgaattccttgagcgtcatctcatttttaagggttccgacacggccgagtcctttttcggcaggagtctgttcaacaggatagatatcgtaagcaacttcttcatatggatggctttttatcattgcattgataacagctttttcgacgcttttaggaaatacagtctcaagccttacttcatgaacaagctcaagctctcccacttcaccgataaaaggcttagctccgtctaatggtttaaaactgccgattccttcagatgaaaacgcgcaatggctgtattcaccgatatggccagcccccgcatttccgagcgcggctctgacctgctcttcatattccttcggcacgtatactgccagctttttcagaggatccgtataagtaggcaccagcacttccgtctcactcagctctaatgcttcagcaagcaaatcattcacaccgccgtccgcaacgtctaaatttgtatgagctgcataaacagcaatatcatgcttcaaacacttttcaattaaccttccggcaggctgatctgttgaaatatgctttagcggccggaaaattggtggatggtgtgcaataatcaagtcaacctctttttcaatcgcttcatcgataacgctctctaacacatcaagtgtaaccatcacatttttaattggtttgtttaaggtgccgatttgcaggccgattttatctccttcaaccgcataggctttcggggaaaattgttcaaacagctggatgatctgctgcccatttacacttttagccatgatcgattacctcctttaacagctccattcgatcggcgagctcctttaatttttgtttgttttgctctgtatccgccgcttggctgatctgttcataaatgctttgagtgtgctgaagctcttgtgtccactttttcaaaaagacagcatttttttcttttgccaagaaagggccaacgagcatcccggctgataaagaaataccgtcataagccgcatccctgtctcccgcttctgccaccagcacctcatagcactttccgtcctcttcaaggattacctcatctatcagcgcatatctttctttataaagccactccctgatatgaacagcatgaatattcggctgtaaaatgagccgttccttccccgttaatttgtctttgcccgcttctaaaatatgagcgatcaaagatccgcccattccggcaatcgtaatggcatcagcttcaccttttttaatcacttccagtccgtctccctgccttacagaaatgtgcgagtttaagcctgatttttcaacctgccgctttgcagacaaaaatgggccgtctgttatttctccggcaatcgccccgctggctttatgattcagcaccgcaaaacaaggaaggtaggcgtggtcagagccgatatcggccatcaccgctccattcggtatgtactccgctactgtttgcaatcgtttagataattttaattcgttcacttgtcatcacaacttttctcaatcattttttcctttactatcatataaaaaatcagcccggaatccaagctgaagcaaatgattttgaaattatttcttttgatgggggtctgcacgcggcagtcaaaaataaaaggctgtcgagaacatctcggcggcctgtgaatgtataaagagaaaaatggttcttttatttaatttttgacacccactctgccatatcatccagcttatcggccggtacaagaccggaaggcattccattaccgcctttttcgatctttgttttaatttcagcgacatctttcttatcccctacaccttttaagctaggacccgaaacaccttcataattttcaccgtggcatgcgatgcagtttgccttgtaaatttcttctggtgaagcgtttgcatctttcttttcagcagatttgctttctcctccgcttgcaatctcccgagagtcatcaagtccttttactgataaaaagaaagttagaccaattcctaaaacagcgatcagcaaaaatggaataagcgggttccatttcatttcccttccccctttttgatccttccccctatgtaaacacttctaattctaacttatttttacaaaaagtaaatggattgctatacaaaagttttttattcacactttatacaaaattgaattgaaacatgcctaaatctctaatatcctttttattctattgtataatgtattgtatacgcttacaatagaaaatatggaattagattttgaaatttttcaccacaatgttcatttgcaaatgacatcatttttcagtaaaataaaggcatattatccatatatctttttaaaaaaaagaagaacggatcttcaagacccgttccatcttattcaaggaaatctttcaaacgtttacttctgctaggatgtcttagtttccgcaacgctttggcttcgatttgtcgaatacgctctctcgttactccaaatactttgccgacctcttctaatgttcttgtacggccgtcatcaagaccgaatcgaagacgcaatacattttcttcacgatcagttaacgtatcaagcacatcttccagctgctctttcaatagctcgtatgcggcgtggtcagaaggtgaagttgcttcttggtcttcaatgaaatcaccaaggtgcgagtcatcctcttcaccgatcggtgtttccagagataccggctcttgagcaatctttaagatttcgcgtactttttcaggcgttaaatccatatcttccgcaatttcttcaggtgttggttctctgcctaagtcttgcagtaattgacgctgcacacggattaatttattaatggtttcaaccatatgaacgggaatccggatcgttctcgcctgatcggcaatggcgcgtgtaatcgcctgtctgatccaccacgtagcatacgtactgaatttataacctttgcgataatcaaatttttcaacggctttcatcaggcccatgtttccttcctggatcagatcaaggaacagcataccgcgtccgacataccgttttgcgatactgacaacaagccgcaggttcgcttcagccaatctgcgtttagattcttcgtcaccttcttcaatcttttgagcgtaggcgatttcttcttttgcagaaagaaggttaacccgaccgatttcctttaaatacatacgaactgggtcattgattttaacgccaggcggtacacttaggtcattaaggtcaaattcttcttcggctttggcaagctgctgaatattaggatcttctgtttcttcattctcactaattaattcaacaccttgttcacctaaaaattcataatactcatccatttggtctgattcaatttcaaagctggacatacgctcagcaatttcttcatatgtcaaaacgccacgttttttaccagactctgttaattgctcttttacttggtcgaatgttaattctgtctcgtgggtttgtttatcagccattatggatccctccttccaaagcttgcaacgaattctataagcggtatgattcttattcggtccattcaggcgttttctatgtgaactgcctttaacaatgtgcgaataatgaaatgacaattcatgatgaggttaagcgatctatttgctcctccgcaaggaatcattgccaataaatgctcctcatcagttctccagttattttaaagatcggttcaatgtaacgatttcttgagccagagaagcagctcttaaaaaatctttttgcctttcggcttcggctctttccgcctctttttcttttatcattgaccaatttctttgattcaacactttttttacataatctgataactcggcttcgctaagctcttgattaacctgaagcattaatatatcggacaagagctggcttatatgatcatccgtcaccctggccatcagatgctgaggcgtcagctcggctccctcttcataaaaagcataaagataagcggctaatgcccggtgctcatcaatattaaattgaaaccctacccggtcaatcacttttttgatgacgctccgatctcgaagcatgtgagcgagtaacagcctttctgcattttcatacgccggacgcaaacgtttttgccttgcttttgtcgtcagatgcgctcgccgcgtttttgtttcaccgctattgtcagcaggtttgttttgcttgctgaaaacagacagctgctcagttaaagactcctgtgaaagcgaaaactctgaagcaagctgctttacatagacttcctgctctagagaccctgaaagcgtgctgatttctttcagtacgtctttaatgtaagctaggcggtcgccttcatcggacaggttctttccttttcggaaatattgcattttgaacgccattacggtgacacttgcgtcaataatgtcgtttttaaatttttccccgccgaattttttgatgtaatcatcagggtccaatccgtcaggaatcattgcaactctgactttgcagccttttttttgcagaagctccgaagcttttaaggtggcttcataaccggctttatcagagtcatagcaaagaatgatttcttcgacgtttcttctcaggatcttgacatgatcatctgtaagagacgttcccatcgtggctatgctttcctttacacccgagcttacggccgatatgacatcagcaaacccttcaaataagactgctctttcctgctttctgatatgaaggcgggccttataaaaattgtaaagcagtttgcttttatgaaagagcggggtttcaggactgttcatatacttaggctgctggctgccaagagccctgcctgagaaagcaacaacagccccgtgatgatcatggatcggaaacatgacacggtttctgaagcggtcgaaatatccgcttccgtcttcgcgtctgatcaggagacccgctttttccatttgcgcctcactaaatcccctctttacaaggaatttcgtgataaagtcccaagaatcaagagcatagccaatctgaaattcattaatcagctctttcgtaaagcccctagaaagcagataatccagtgcctcttgaccttcttttgtatttattaacaaatgatggtaaaatttcttcaggagctcatgtgcctcagccattttttgttctccagaagactctggccgggctccggaatggactgttatatcatctggaaaatcaatttggtatttgtcagcaaggtgagaaaccgactcggcaaaagaatagccttccatctgccttaaaaaagagaaaacattgccgcccgctccgcagccaaagcaatgaaaaatctgtttgtcgggcgatacggaaaacgaaggtgtgctttctccatgaaaaggacagagtccaaagtagtttcggccttgcttctttaattgaacataatcacctatgacttcaacgatatctgccgacttttgcacctgatccacaatttcatctggtatccgatttcccatcttataacactccgtcgtacattattcgatgctttagtgcaaaatcccttcatcgttcgacaggattttttgcagcagtgtaataaatcgttctcgatcttctttattcaattttttaggccctttggcatatacgccttttcttctttgtttgccggaaaaatgacggccctctagggcaaaatcaatcgtgtcttccttgtaaagacgacctctttccgacataacagagacatttctgttcaacagcagagatgctaatccgatgtcctgcgtcacaacaatatctcccggtttcacgtgatttgcgatatataaatcagcagcttctttatgaggatcaacatacttccatttttcttcattgcttctggaaagctgataatgttcaaatgaagcgacaaaaagaacttgaacttcatactcggatgctgtttgtaaaatttcatcttttaccggacaagcatcagcatcgacaaaaatcgtcttttcttgttcattaagaagagtaattctccatccctccattaaactcctgcataaaagcaagcaaaatcgcacatcctttattattgtggatgtatatgaatttgtcgaaaaatttccgggagaaattcttgacatcttacccataatagtttattcgtatcacacgatccttaaacctaaaattaatcattttatcacaattttttattataatacaaacttcacaaagatgctattgtttttcattattcccttttggcacagccaaaaacccaggatagagcgtcctgagttatatgttttttgttttgagatgatggataatatttgctgtttcctcaaccgctttatttgaaacatcaacaacctggcagccgatccgatccacaatcttttcgaaatactcgagttcctctttgattctgttgatatttgcataaatcgctttatcattaagcccgagtgattttaaacgttcttttctgatatgattcagtttatcagggctaatctttaaaccgatgcattttttcggatcaacgttaaagagttcttccggcggatcaacctccggtacaatcggaacattggcaaccttcaggcgtttgtgtgcgagatattgagacagcggtgttttagacgttcttgacacgccgatcaaaacgatatcagcttttaaaatccctcttggatcacgtccatcatcgtatttaactgcaaactcgatggcctccacttttttgaaataatcttcatcaagctggcgcacccgccccggttcgtatttcgctgttaaaccgtaggctgtttccattttatcaatcaacgggccgataatatcataatataaaacatttgctttttccgcttcggctatcaaatattctctgatttccggcaccacgagtgtaaaacagataatgccgcagtctgcctttgcaagtgaaatcacttcattgatagtgcctatatcttcaacataaggaattcttcttacatgagtatcatccgccgatccgttaaattggctgagtgctgcttttactaccaattcagccgtttcaccgacggaatccgatacaacatagatgatgcggttattcatattatccccccgttagtttgcaatcttataggatttcattttcagataaactgacaagtattttggtcatatttgtttttgtcactctgccgatcacttcaaagcctttatcggtgtctttgatgacaggcagtgcatcaatttgtttttctattaagtgctttgcaatgtccatcacataatcctcgcgtctgcacaccgtaatgttcggcatccttgtcatgatgatgtgaacagggaccgatgtaagctcctgctggccaatgctcgctctgagcaagtcttttcgtgaaagcaccccgactaaaacagcatcgcggtccaccacaaacagagtacctacatcttctaaaaacatggtgcaaatcgcatcgtacacagaaacgttttcgtgaatcactacggggatagattgaaagtctttcacctgaagctttttgagtttatccgccaaaagctgtgtgccggtttttcccgtatagaaataaccgactctcgggcgcgcctcgaggaatcctgacatggtgagtatggctaaatccgggcgcaatgtcgccctggttaggttcagcttttctgcaatatgctcccctgtaatcggcccgttttcttttacaatctgcaaaatatgttcttgccgtttatttagttcgatcgtactcaccaccttttcacttcatagctatgtaaagaaataataatccatattataacgtaaatatcttgtaatcaaacaaaaaacttataaatggggaaaagacgattaccgatcacacagcaaccgccttttctctctttattttacaataagggcattcatattcgcaaaggacttgatctcatccgccaagcttaccatttgcgctaaacgatttgcctttaatgactcattatccgctataaccattgtatgatcgaagtaagcatcgatcggttcttttaaggctgcaagtgaagcaagcgccgcctcataatcttttttgctgaagttttcctgcagattttgcttcgctgtttggtaggcatcaaacagttttgcttcgtattcattttcaaacagatcaggctgaatgtctccgcggactccttttttgctgatagagatcactcggcctaacgcttcggctgtttccttaaagccaggtgcaccaagcttttgctccagtacttgtgctttatgcagcgcagagtacggctcaagctcagagctttccagcacggcgtcaatgacatcatgtctgatttgttcagcattcaagacatatttcaagcgctgagtgaagaaatccagcagttcattttctttatcggtttgaacgaaagtaagcagctcttcaaatgaaattccccagttgcggtcaagaagaatcgcaacaataccgcttgcttggcggcgcagtccgtaagggtcctgggaaccggtcggaattacgccgatagagaagaatgaagcgattgtgtcaagcttatccgccattgctacaacagctccggtgaaagtagaaggcgtttctccgcccgctgatctaggcatataatgttcattaactgccgcagccacagcttcatcttcgccaagcattctcgcatacttttcgcccataattccttgaagttcagggaattcatatatcatatgcgtcacaaggtcgaatttagaaatttcagcagcccgcttcacatgttttaatgtatcttcatcagcctgaagacgaacggcaagtttctctgcgattgatgtgactctcctaaccttatcagcaagagaaccaagctcttcatggaaaacgatattttcaagtttcttcacatttgcatcaatgtttagtttctgatcttccttgtagaagaatgaagcatcagataaacgtgcgcgcagcactttttcattgcctcgggccacattttcaatcgcgtggctgttgccgtttcggactgtgataaagtgaggcagcaggtcaccgtttttgtctttgacagggaagtagcgctgatgctctttcattgttgtgacaagcacttcttcaggaattgacagaaactcggattcaaatgaaccgtaaagagctgtcgggtattctactaaatgattcacttcatcaagaaggtcttcgtcaactggaatgctccaattgttttcagcagccattgtttccagctgagattgaatcatttgctttcggacgctaggatcagcaataacatgctgttctttcagctgctcttcataagctgaaggtgattcaattgacgcttcatgtccgaggaaacggtgtccctgtgttgtccgtccagactcaacgtttgtgatcgaaaatggaatgacatcctgtccaaataatgcgacaatccatttgatcggtcggatataacgcaaatcttcatttccccagcgcatgtttttcgggaaatgcaagcttgtaattaaaccgctcaattctggcagaagcgacttcgtttcttggccggcttggaatttttgcacgaatacatactctatgccttttacttctttgatgtacaggtcttccacatttgcgccttggccttttgaaaagccgattgccgcttttgtccagttcccgtccgcatcaagggcaatttttttcgcaggcccttttgcttcttcttttatatcatcctgcttttctgcgacatccttaacgaacacagcaagacgtctcggtgtattgaagagtttcacttcaccgtgagtaatatttttttctttaagccagcctgtcagcttgtcgccaagctgaaccatgctttcattcaaaaagcgcgccggcatttcctctaatccgatctctaaaagtaaatcctgtttactcatgagaagaaccctcccctttaagcattgggaaccctagtttttctcgttcctcatagtaggtttttgctacttttctagctaaattccgcactcttgcgatatagcccgtccgctcggtaacagagatcgcacctttggcatcaagcaggttgaaagtgtgcgagcatttcagcacatagtcatatgctggatgaacaagtccgttgtccatttgcttgatcgcttctttttcatatgtgctgaacaattggaacagcatatcgacgtctgatgtttcaaacgtataaacagaatgctcatattcagccatcatgaataaatcttttactgtaaaccctgacgtccattccaagtcaaacacgttttctttatcctggatataagacgcgagacgctcaattccatacgtaatctctacagaaacaggtttacactctaatcccccgacctgctggaaatacgtaaattgtgttatttccattccgtcaagccaaacttcccagcctagacccgcgcagcctaaagacggattctcccagttgtcttcaacaaagcgaatatcgtgctcaagcggatcaattccaagagcacgcaaggaatccaaatacagctcttgaatgttatcaggtgacggtttaataatgacctggaactgatgatgctgatacagtctgttcgggttctccccgtagcggccgtctgccggacgtctggaaggctctacataagccactttccacggctcaggaccgatactgcgcaaaaatgtatacgggctcatcgtgccggctcctttttctacatcgtaagcctgcataagcacacagccctgactggaccaatgcttttgcaaggttagaatcatgtcttgaatattcatttcaagcacctccacttttctttcataagttgactgcgacagcaaccaaaaaactcccgtctctatgcttgccagccgcaaacatagggacgagagttctcccgcggttccaccctagttgctgagaacaaaatcccagcctcttttttaaaattgctcaagaatgcctttcgttgcgtgctcatccttagcttccaccgccctaaggtcgctttcatgaggtaaacgcaagtacttctttctctcactgcaacatattttataataaatgatcatataaaaagatggaccaaaagtcaacttttgttttcacccataagatgtttcatgctttccatttgatctaaaaagcgctttgattttaaatacaatcccgaatattcttcgtaatataaatcaatcacttgctttaattcagcttttgtttcctcttttaaggacacattgccgagcctcgacagatcaaaatagtaaaagagtcttaacagccttgccgtttgcggtttgatcggtatcctgtaaggatctttttcaaaacagcggtggcatataaaaccattatcacgaacagagaaatgaaaggttccgtcttggcttttacaatgtacacaatgatttagctcaggatacaggcccatgacaccgagcatcttcatttgaacaatgaaggtgataacatccggatctgttccttcattcagctgttttaatgactctaatatgaattcaaataaataaggatttggctttttttcttctgtgcctctgtcgactaactcagcaatataggcagcatatgctgttaaaaacaagtcttccctgatgcctctcatgctgaggatcatttccccctgctgaagcgttccgaggcccgatgttttttgcattaagaaagaaccatacaaaaagggctggctgactgctgataaacggctgttcggttttttggcgcctcgtgccataacacctatttttccgtgttctcttgtcagtaaagttacgattttattcgtctctccgtaatcatttgtgcgaagaacgattccttcacattttgtcagcatttccgcaccttcctcaagcaggagcggccaagaggtttataaaattggataatcaaatcgggctagctcatcttctagttcttcgggtctttccatgttctctttttccagttctttaaaaagaagatacgtatcaacatttcctgtttgagaaaatacgttccaggtaaaattcaacacaagaaacccacctttctgtagttaaactagcttacctaaactccaaattcttacctttatcttgaccagatgtcctccatttcatgttaaacaaaatttgctaatgtatccctgttcctgtgagataatgacacacacagctagagattaatattcgtcctctttaaagccaaaatcgcgaagctgggacattttattacgccagtctttctgcactttcacccacaattcaaggtagacacgggagcccaacagtgcttcaatatccgctctcgctctttttccaacctcttttagaaggcttccttttttaccgatcacgatgcctttctgggaatcccgctcgaccacaatcgttgccgctacgtgcacagaaccgttgtcctgccctttgatggattcgatggccaccgcaatgctgtgcgggatttcttctctcgtcaaatgcagcaccttttccctgattaattcagaaatgataaatcgctcagggtggtcagttacctggtcactcggatagaattgcggcccttccggcaaatacgcttcaatctgagcgagcaaggtttcgatgttatttccttctaaagcagaaatcggaacaatttccttaaaaggataacgtttgcggtattcgtcaattagcagaagcaattggtcgggatgaattttatcgattttgtttacgattaagaatacaggcgtagacatcgtctgcaatttctcaatgatgaattcgtcgcccttcccgtagccttcctcagcattgatcataaacaagatcaaatcgacttcttttaatgtattttgcgccactttcatcataaagtccccaagtttatgcttaggtttatgaatccctggtgtgtcaataaaaatggtttgtgatgtgcctgtcgtcagtactccttgcaccttgtttctcgtcgtttggggcttatcgctcatgatcgcgattttttgtccaatgactctgttcaaaaatgtagattttcctacgtttggtcttccaataatggatacaaatcctgatttaaagctttcgttcgtcatgtaaatcctccgatgaaaatgcgcctggcaataattcttccacagtcatttcttttatttgtccttgtaaattagtcagtacgacaataacgtcttttgtgcaaagctcagaaatcacctgtcggcaggctccgcacggagatactggtccaggggtgtcagccgcaacggccagcatctgaaactctgtatccccttcagaaacagctttaaataaagcggtacgctcggcgcaattgcacatgctgtatgccgcgttctcaatattgcagcctctgtacacttttccatccttggtaagaagagcggctcctacttggaatttggaatacggcgcatatgccatatcacgcgcttttaaagcttctgttattaattcttgtctgttcatgtgtacattcctctcttacctataatggtaccgctatcactttatattttacataatcgcgcgctttttttcacgcccatttctaaaaatgtaaaataaatgtaagaattttcagccattacagctttggcaaaaaaataagtaaaccaatgatacacgaaatcacggcaaaaacgcaaacagccccggcggcagcgtccttggccgctttagcaagagggtgatgtttgtcagttattaaatcaaccgtatgttcaatggctgtatttaaaagttcaagcgaaaacataccgcctatcaaaaggaatataatcatccactcaatcatgctgagctctacaaggaagccgcaaatgagaacagcgcaggcggctgcggcatgaaattggaaattccgctccgtccgcgctgtttcccatatgccccggcctgcatgcacgaagcttttgaagaatcgattcagctcatttctatgatcttttgagtccataagcgtccagcaattccttttgcttagtaaacatctcctcttcttcctctttcgtcatatggtcatatcctaaaaggtgcagaaatccgtgtacagctagaaatccgagctctcttttaaaagaatgattatactcctctgcctgctctcttgtgcgatcggcactgatgataatatcacctaaaaccggaggcatttcggcgcccacgatttcgatctcgccttccccctcttcttcaagagcaaatgagatgacatctgtcggagcatcctttccccggtattctttgttaatctgatgtatgtcatcattggaaacaatcgtgacagaaacttcagcctgatcctgaacgccttcacgctcagcggcaaattgaagcagattttctacttctttgagcatctcttctgagacgcttcccgtttcatcaacgatatcaatcagtaaactcatctatttcaccttcttagtagcctccggatattcaatccgggagtggaaaattccttttaatgttgcacagagcgtttttgcgattgtatccagctctttaaatgtcaaatcgcattcactgaactgtccgtcctgaagcttatcggatataataccccggacaagcttttcaattcgttcaggatttggattatgcatggatctgacggccgcttcaacactgtcggccactgatataattgcggcttcctttgactgcggcttcggccccggataacggaactcttcctctgtaatctggtcgcctttttccttcgctttatagtaaaaaaactttaaaagcgaggttccatgatgctgctcagcaatatcgacaagctctttcggaaatttatagcttctcagcatattcgcaccgtctgtcgtatgcgagataataatatttttactcaactgaggtgacagcttgtcatgcggattgtcaatattcatttggttttcaataaaatattgcgggcgctttgtttttccgagatcgtgataatatgcgccgactcttgcaagcaaaccattagccccaaccgcttcacaggctgcctctgataaattggcaaccattacactgtgatgatatgtacctggtgtttctgtcagtattttgcgcaatagcggatggttaggattagacagctcgagcagcctcatggtggataaaatgccaaagcccgtctcaaaaaacggcatcaggccgatgatcaatacagatgaagcaaaccccgacacaacccccatgagcattaacgtgccgatttcaagacccgacagcgcagtgttctggatcaataataaggatagaacgacaaccatattaataaacgccacgaaaagtccggtctgcaaaatctttgatcttgcattgtgttttcctaaaaataatacacctgaaatgccgctgatcaaataataaatccctatgacataattgaatgttcctgtcacaccctgattaaacatcatacttccgcaaatcgcaagaatgatacttcccaaaatggcaatgcgttcattcatcagcagtttgattaagatggcgcctgccgcaatggggaccagatagccgatattattatactccatcttctgaaacaaactgacaacctccatgatcacaagcaaaagtgttgtgataatcgagaataacagaatggattggtttttaaacttcagattttgtttctgtttttcaaaataatatacaagtgttgcaatgaaaagtccgatcataatcaatagcccgctgatcggtttaaagagatttgagttatttaataacccagtcagctcaagtttcctgtacacttcccgatcaatgaggtcattttcttccacgagcacttgcccctgtttgatttggacctgctggacattatctgaggcttcctgccgttttgcctctgttgctttcggatcgaaaacgtaattcggaataatagcaaaacgcccgatttctgtcgcagctcccaagtatttagacggaatagaattgctctttagctctttttctaccttatcctttgcatcagatagtttatccgaggggatttcactgctcatgaccgtatttactgcggtaatgaccgtatctctgacaaaagaaaagtcttcactgtctgctttcagcaatgtcttgatggaatcctccgatatagaatcattcacatctgatgtcaatttgtcctttacagatttgaccattgatttttccgatggtgatttactgccttcctccgatgattttttcacttcactaatactgtcgaatattgatgacacaaggtcaatccgattgtctgtatattctttttttaatgtatattgatcttcaaccgcgtcctcagcggcttgctttttttcctctgtggctttttgatcttctacggttgccggagcgtaaatggtcttgtcgctgactgaaaacaggtctaaatcaagtgtttccggcttaacatgtacaaagagcaaagcaaacataatggcagccagcagaagatacagcagtacatgcatggagcgggcatttttaaaactgctccattttttcgagctgcttttggtcttagccttctttttcaacacaagaacctcctcttgaaacatcaagcccataagcaatcataaaaatgacccgataacgcgcgatcgggtcattcagcattaattttgcttatcgtatgcttcaataattttcgcaacaagcggatgtctgaccacgtctgtctggtctagctcaatcatagaaatgccgtctattcctttcagcatctccttcgctactgcaagtcccgatttgacgcctttcggcagatcaatttggctgacgtcacctgtaatgatcattttagagccaaaacccagtctcgtcaaaaacattttcatttgagcaggcgtggtattttgtgcttcatcaagtataacataagcatcatcgagcgtccgccccctcatatatgcgagcggagcaatttcaatgatgcctctttccatcagacgttctgtatgatctgccccaagcacatcatggagagcgtcatacagcgggcgcaaataaggatctactttttcttttaggtcacctgggagaaaaccaaggctttcaccggcttccacggcaggtcttgttaaaatgatttttttgatatgtccgttttttaaagcatggactgcttttacgacagccaggtacgttttcccggttcccgccggaccaatgccgaatacaaggtcattccgcttcatagcggccacgtattcccgctgtcccattgtttttacacggattgatttgccttttgcgttttttgtaatttcttcttcatacatgctttcaaagtattcaagttcattcttctttgccattttgatggcgtaaatcacatcacgttcagagatctctatccccttgcgaattaaagcgaggagcgatcccagcagcctgtctgcaatctgaaacgattcatcatcgcctgacacataaatcgtctcgccgcgcgtaatgatatttacattcagatctttctccatcaatttcaaaaaagaatcttggttcccgaagagtgaaagcgcctcgtccgggtttttcagtttttgattcatcgcaagtaaatgttctgtcattcttcagtctccctgacaataggtgtggtttgaacgatatcttctataacttggtagagaataatcaactttactttaccattctcaacagtctggtgcaaaactttttcacttttcacctcgccgttttcgcctattttatcctctacatcctgtttacccaatttaatgccttcttgaactgcttcttctttcgtatattttcgcaaagcctcttcactttctctcgtttgctctttgacataggatacagggagcttaaatccgagaaaatgaagcgaatgcttttcttgttctgtttttggatgcttcaattcctcttttttaaacgtcatcccccagatcgggattgccaaagaaccaaaagaaagcttgtgctttgtccttactttgcccgtatagacgttaaataatgtttcaagcgggactgtcacttctgatctataccaggtttctccgtaaatttctgcttttgaggcgacttcctgctgatggtcttcgctgccgatcagtcccgaaacaagcagctgtcccttttcaacatgatcgtgtatggcggccatgggctgtcctttttgcacaaacattctcgtaatggttgctttctttttggcgacaatattgcgcgggctaacatatttttctttttcgggctcatttttctccacaactttcatatgaatggtcgtccccttcagatcaactccgacccaagtgatattgtctattccattggttaatgatttctgtattttttcgggcgacatcattaaaaactgcagacggccctttttgacgccgatttcattaagatgctgcctcatttgatgttctgtttcaggcttagcgcctgtcacatcaattttccacaccatattggacagcaaaaacaaaagaatgaaaaaaatcgcaaaaccgatcgtaaaccctatattcagctttgatttcagcaacaggaagggaaatcccttccgattgataaatcgggctttacatttaaatttacttcttacccgccgaaaggcatgtacatcctgaagctgtatatataacgatacggcttctttcttttttttgacatgaaagaccggaatcccctgtcttgtgcattcattaaggagccgctcaatccctcttcccgtcaattcaagctggaccttacccgaaaaaaaagacagccatttatttttcacaacatttccccctcggctttatgactcaacatatcgaacgacatcaatcgtaccctccaaaagtatctcttccggaagaatcgccttgatgacaaaatttttaccagatatgatgcactggccctgcttcagcatcagccgcacttcattctcactgaaaagcaaaaggcctctgtggttttctatgtagatatgaagtctgccaaccattgtaatcctcggcagatccatcataacgtccgggggaatttccaatgctcttgtcagccaagctttcatacgattctttctttgccccatacaaaaagaaccccctttcatctcatatgtatgatttgaaaggaggttctaacactttaatttttacgggccgggcgcatcgtacggtgaggttttttcgcccgtggaggtccgaacacctctcctagaacgatcccctgtacgacggtgtctttattcacctgaagcattttttgttttgtgtatactgttttttgtttggcagcagcaagatctcgttccagccctttcaggtttcttgctgtttccctgcgtctttcttccgcttcccgtcttgcctgttccatacggttagggataggtgcaggggcatcttcttttgactgcttcttttgaggagaagcagattgcatgtgttgaggttttttacttttttggctgttttgcttttcttctttgctctttttgccgaaaatcgcagaaatgattccgatgatcgctgcaataataagcggattggtcagtaaatcttccatcagcgttctcccttcttagagagattatgatttgcggtcttcatccgaagggtctttcgtcagcttgccgaatgaatcacgcatttctgtgtcagcatcgatgttcttgatattcatgtaatccatgacgccaatattcccttcacgcaaagcttctgccatcgcaagcggcacttccgcctcggcttctaccactttcgcgcgcatttcttctacgcgggcacgcatttcctgttcttgagcgacagccatcgcacgtcgttcttccgcttttgcctgcgcgatgtttttatcagcctcggcctgatcggtttgtaaaattgccccgatgtttttgccgatatctacatctgcaatatcaattgagagaatttcaaacgcagttcctgagtccaatccttttccaaggactgtctgagaaatcatgtcagggttttcaagcacttttttatgattatcagatgaaccgattgtagaaacgatcccctcacctacacgagctacaatggtttcttcccctgctcccccaacgaggcgctcgatattcgctcttactgtgattctcgctttcgctttcacttcaatcccgtccattgcaacaccggcaatgaacggtgtttcaatcaccttaggattaacgctcatttgaacagcttccaacacgtcccggcctgcaagatcaatggcagcacagcgctcgaatgtgagttcaatgttagctcgctgagcggcgataagcgcgttgacgactctgtcaacattacctccagccaggtagtggctttcaagctggtttgttccaacattaagtcccgctttatgggctttaatcagcgggttaacaacccgattcggaatgacacggcgaagcctcatcccaactagagtgaaaatgctgattttcactccggctgccaaagctgaaatccaaagcattacaggcacaaatgtaaaaaatactgccaaaacaatgatcgctactgcgacaattgccagaatcataagtgttgacggatccatataacttctcctcgtttctatttaaatttctctcacgacaatgcgtgagccttctactttaatcacttttacttttttatctttttctgtaaacgatccctccgaaacaacgtcaaggcgttcatcatcaataatcacggtaccggaaggacgcagcggtgtaaaggttatacccacttttcccattaagtccgtgcgcgtttgatttgaaacgtagccgctctccgtgtttgtagaatcatttaatatcaatttcttaaagaatttcatacgctttcccaacacccttgtcagtaaaataaaagctgtaatcgaaacagctgaggcgatcaagagagaaaccgccatgacagtgaagctccccgcggctaaaaacaggctcgcaataatcgctcccaaacccagtaatccaatgattcctccgggaagaaaaatctcaagcagaatgagaatcacccctgctataaagaggagaaccgtctcatacccggcaaggccggctgcaagatgcccgtaaaagaacagcaataacgcaatgagtccagccgttccagggaggccgacacccggggaaaaaagctctaccgtcagacctaaaaaagcgattgtcagcagaatagggacaatgaccggattcgtcagccatcttgctgtcttttctgcaaagctctcctttgcatagctgatctgcgccttttcgaacccaagcttctttacgagcgtggacaaattgtcagcagtgccttctgaatagcctacctcaatcgccttgtctgcgttaagtgtcagcagatctcccttaggcgcgccaacttccttggcatctatatctgggtcagccattgcgagcgcatattttggatcgcggttatttttcactgcggcatcttccatctctgccagccaaagtgattgagctttttggtcagcggcattgccttggccatcaacaatcgcggaggctcccatttttccgccaggcgccatataaatgtgatctgcttgaagtgcaatatatgcaccagcagacaacgcgcgtttgttgacatatgcagttacggggatctcactttcggttatcaaatcggccatatcaatagcagatttgaccaatccccccggggtattgatatcaagaataatatggtctgcatgtgcatcctttgcgtcttgtaacgaacgggacaaaaacgaggcgagaccctgttcgacatttttttcaaccgggatcacataaacagtttgtttttctgcttttgcgttcagctgtacgcctaataaagaaagtaaaaatatacccaaaagagcagcacggaatcctttgatttgaagcaagggcggtgtatccctccttccttttataataagtgccttctcttcatacgtaacaaatgtatcaaaggtttcatttttttatgtataaaaaaagacatctctcttagaaagatgtccttttctttgccatttaagacagttgactgctcacaagcttattaattaaacttccgtcagctttaccttttactttaggcataattgcccccatcactttgcctatgtccgcttttgagctcgcaccgacctccgcgatggtttcatttacgattgtacgcagctcttcttctgacagctgctcaggtaaataaacttctaaaatgtccagctctttttgaactttatctactaaatctaaacgattagcgtttgaaaattcctggagggagtctttacgttgcttaagttcacgagaaaggacagtgagttcctcatcctcggtcaaactgtctttcttaagcttaattgcttcattttgaagtgaagccttaaccattcgaacgacagtcagtttgtctttctcacggtttttcatatacagcttcatatcctggttgagacgctcaagaagactcataaatccaccctcttttagaatttgcgttttctagcagcttcagactttttcttgcgctttacgctaggtttttcataaaattcacgctttcttgcttcttgcaaagtacctgtctttgatacactgcgtttgaagcgacgaagagcatcttcaagcgattcgttttttctaacgaccgtttttgacattctctttccctccctccgaatacaccaatcgactacctttaagttacacatataaacatgtactttgacattataatataagccatcagtcaggtcaactaagtgagttcacttttccgtcatgagtgcgactgcctgtctatataatgaaagaaaggggttggtgaataggatgttaattctgattagctttactgctcttatattattctttctcgcaggcatgaacatgcttcgaaaaggcttaatttctatggcgtactcaaaaattgaagaacgtttgcttttatttacggaccatccgttaaaagcgtttcttatcagcattgtatttacgggaatacttcagagcagttcagcttttatggtcattgtcatcggctttgtaagtgcgggcgttctttcttttaagcggacgataccaatgattctggggacgaatgttggctctacttttacaactgaatttattgctatcaaaatggatattttgatctgggttcttttaataggaggtttattgttttttctgactggcaggtatcctttgaaacagctgggaacaagcttccttggactgggcatcatcttcttttgcatcagcggattcagccatcttgccgggccgctgacaaagctgaaaacgggagccgacgttctataccatgttaacgattcaaactggtccgctttgctcatcgggatggtgttaactgccatcattcactccagttctgtctgtatcggcattttgatgagttttatgaatgaagggattatcggactgacacaggcgatgagcgtcgtactcggatcaaatatcgggacatgcattacagctgtcatggctgctgtatccgggggatatgcggcgaaacagacagcgtatgcgcatgtggtatttaacgtgctaggggtggctctagtattgccttttctgaccgcagcgaccggctttgtagagcagttatcacccgatcctgcccaaaggattgctcatttcagccttttatttaatgtggtgacagctcttttgtttcttccgcttacaaacttgttttaccgcttgattcactttcttatcccggctaaataaaaaaccggtacattttaatgcaccgattttttaggttaagaagacaaacgcatatgttcagttatttcatcctcaaccacacggacaaactgtccttcgttgtaaggataacctgcttttaggattttgacttttacgattttgccgatcatatcttccgtgcctttgaaaacaaccttcatataattgtctgtgtaaccgacaaacatgttctcttcttctgtttctttataggcttcctcaggaataatctcaagcacttcattttcatactgagaagcgtattcttttgcaagctggtcagaaagagcaatcaggcggtgcacacgttcgtttttcacgttttcatccacttggtcttccattcgcgcagctggtgttcctgtacgtttactgtaagggaaaacatgtagctcagagaatttatgttctttaataaagttataggtttccataaattcttcttctgtttctccagggaacccgacgatgacatcagaagtaacagctaagcctggcagtgcttttttcaatttatttaaacggtctgcaaagaattccattgtatacttgcgtctcatccgtttaagcactgtgtttgatccggattggataggaatatgcaaatgattcactatcttatctgagcggtctaagacctcgatcacttcgtcagtgatttggctggcttcgattgaagaaattctgatccgtttcacgccttccacacgggtgtctaattcgctcaaaagcttagcgaagttgtaatctttcatatcttcgccgtagccgcctgtatgaatacccgtaagaacaatttccttatatccggcatcaacaagctgctgcgcttgtttaatgacctcttcaggatcgcgggagcggagcaggcctctcgcccacggaatgatacagaatgtgcagaaattattgcagccctcctgtattttcaatgacgctcttgtgcggtccgtgaaagcaggcacatcaagctcttcatatactcttgctttcatgatgttgctgacgccattaatcggctggcgttcttctcggtattggtcaatgtagccaagcattttttcacggtcctgtgttccgactacaatgtcgacaccggggatcgccataatctcagcaggtgaggtttgcgcgtagcagcctgtgacacagatgacaccgtcaggattttgacgaatggcgcgtctgatcacttggcggctttttttatctcccgtatttgtaaccgtacatgtattaatgacatatacatcagctgtttgttcaaagtctcttctttcatagcccgcttctttgaaaagctgccagattgcttctgtttcataatggttgactttacagccaagcgtatggaaagcaacagttgccattactgatcacctcttaataactctgtttgataagaaatcgcgctcaacgcgtatagcggagcggtttctgtccttaaaattctcggtccaaggccgcacggcacaccgtcttgctctgtgagccgttcaacctccgcttctgttaaaccgccttcgggaccaaatacgatcaatagagatgatcccttcggaaggctgcttacaatcgcgctgaatgcgcttatttccccttgcttcgatgactcctcgtatgcaacgacacatttatcgaaatcctgcatcctttgaagaagctgctgaaaagaatggacatccatcactcgcggcacttcgttacggtacgattgctcagccgcttcctttgcaattttcgtccatctttcccgctttttctttgcctttttgtcatccagcttgacaacagaacgcgcggcttggaaaggaataaaggcatgagctccgagctcagtccccttttggataatccattcaagcttatctcctttcggaaggccgctcgcaatatagacctttatcggaagctctctgttttcattcgtccattctatcacaaggcaggacactttatctttggaaacagattgaagttcacattttgcctcgaagccgtcttgagagcagcagataatctgatctccctcattcattctcatcacgttcacaatatgatgaacatcttcgccggtaatcgaaaaagccggcgcttcctctatttgctgcttcgtgagctcgataaaatatcgttgcatacgctgtgacacctactaactgttattttttcgcaataatgctgacccaatcttccattgaaaggatttctacaatggtaaagccagcttgttccagtgcttcttttacttcttgttttttatgaccgatgattcctgacgtaataaagtggccgccttcttttaagaggctgtacgcttgtgaagtaaagcgaagaatgacttcagccaaaatgttggccacaatcacatcatgttccccttcaatcccgtctaacaaattgttttgcttcacttgagcaatatcgctgactttgttcagcttgagattaaggcgtgcactttctacagccacgggatcaagatcgtaggcatgaaccgattcagcctcaagcattgcagccgcaatacttaaaattcccgaaccagtgccgacatcaatcaccttatcacccttttgcacaaagcgttcaagcgcctgaatgcagagtacggttgtcggatgtgtccctgtgccgaaagccattcccgggtccatttcaataatcagttcatcagtatggaccggcgtatattcctcccacgtcggcacaattgtaaacttttcagaaattttcacaggatgataatactttttccaggcagtcgcccactcttcttcatttacttcagaaatagtgatgtggtttctgcccaaatcaatattgtaaagaaggagattattaatcgtttctttgatgccgtctacagtttcgcccagaaaactgttaaccggcagatatgctttgacaatgacaccctcatctgggtaatcattggggtcgagctggtagatttccccgtacacattctcacgttctttaattaaatcaagcgggtcctctatcacaaccccacttgcaccagcttcatgcaatatatttgagataggttcgaccgcttcatgtgttgtgtgaatgcttaattcggaccatttcaaaactaccaactcctcatccaataattaatcgcctttaaacgcccgttttaccttgtcaaagaaactcatttcctgttcgtcaggcaggtttccgctgacttcggcaaattcgcggataatgtctttttgtttatctgtcagatttgtcggcgtaacgacgcggacgacgatatgctggtcaccctgtccatagcctctgacattttgaacgcctttgcctcttaatctaaatttcgttcctgtttgtgtaccggccggaattttcaatttcacttttccatgcagcgtcggcacttctacctcatctccaagagcagcctgagcaaacgttaacggcatttcacagtaaatatcatcgccgtcacgctcgaagaactcgtgtgcgcgtacatggaacacgacaaataaatccccagcagggccgccgtttattcctggttcaccctgtcccgagagacgaagctgctgcccgtcatctacaccggctggaattgtcacattgattttcttgcgttttttgatttttcctttgccgccgcagtccgcacatttgtttttaatgattttgcctgtaccttcacagtggtggcagacccgtctgttaacgacttttccaaacggtgtattttgctccacgtttaactggccggagcctccgcagtgggagcatgtttctggatttgttccaggtttcgcacctgagcctttacatgtttcgcacgtttcctcgcggggaatttcgatggttgtttctttaccgaaagccgcatcctcaaacgacagggtcatcgtatactgtaaatcagcaccctggcgcggagcgtttggatctctccgtcttgtgcctccgccgaaaatacttgagaaaatatcatcgaaaccaaaaccgccgaaatcgccgccgccaaaacctccgccgccgaagccttggttagggtcagtgtgaccaaattgatcgtaatgcgcacgtttttggtcatctgacagcgtttcgtacgcttcttttacctctttaaatttttcatctgatccggcttctttgttaatatcaggatgatatttttttgacagcttccgataagcttttttaatttcatcctttgaagcgctcttacttactcccagcacttcatagtaatcacgcttactcatctcgcttcactctcccgaatttctcacataaattagattgtatcattttgaattatgatttttcaattccttttatcccgggcaagaaaaaaagtcaaagccaagagatgcctgactttgactttctaatcattgaatcagattatgaaatgtgttcttttcggtcagctccggaagcggggctgacactaaaaagaacttattttttgttttggtcgtcgtttacttcttcgtattcagcgtcgacaacgttgtcatccgctttgccttcagcgtttgctccgccttgagcttgctgtgctttagcagcttcttcataaagcttcatagaaagctcttgaacgattgtttgaagctcatcctttttcgctttgatctcttcaaattcgtttttctcaatcgctgcttttaaagcatctttggcatcgttggcttttttcacttgttcttcgtccactttgccttcaagatcttttaatgttttctcagtttggaaaacaagctgatctgcttcgttgcggacttcgatttcttcttttttcttcgcatcagcgtcagcattttcttccgcttcttttaccatgcgttcgatctcttcatcagagagacctgaagaagatttgattgtaatgttttgttcttttcctgtgcctaagtcttttgctcttacgtttacgataccgtttttgtcaatatcgaaagaaacttcgatttgaggcacgccgcgcggtgctggcgggatatcagtaagctggaagcggccgagtgttttgttgtcggcagacattgggcgctcaccttgaagaacatggatatcaacagctgtttggttatcagcagcagttgagaacacttgagatttgcttgtcgggatcgtcgtgttgcggtcgatcagttttgtaaacacaccgcccattgtttcgataccgagagaaagcggtgtaacgtcaagaagaacaacatcttttacgtcacctgtgataacgccgccctgaatcgcagcaccaagcgctacaacttcatccgggtttacgcctttatgcgcttcttttccagtttcttttttgattgcttcttgtacggcagggatacgagttgatccgccgacaaggatgactttgtcgatttcgcttgcagaaagtcctgcatcttgaagcgcttgacggacaggacccattgtgcgctctactaaatgagaagaaagctcttcgaatttagcgcgagttaatgtaagttcaaggtgaagcggtcctgcttctccagctgtgataaacggtaaagaaatttgcgtagaagatacgccggaaagatcttttttcgctttttcagctgcgtctttcaaacgctgaagcgccattttgtcttttgacaaatcaatgccgttttcttttttgaattcagacacaagatgatcgatgataacttggtcaaaatcgtccccacccagacggttgtcgccggcagttgaacgaacttcgaatacaccgtcgccaagctcaaggatggaaacgtcgaatgtaccgccgccaaggtcgtatactaggatcgtttgatcttcatctgttttatcaagtccgtatgcaagcgctgctgcagtcggctcgttgatgatacgttctacttcaagacctgcaattttaccagcgtcttttgttgcttgacgctcagcatcgttaaagtatgcaggaactgtgataactgcttttgatactgtttcgccaagatagctttcagcgtatgatttaaggtgttgaaggatgatagcagacacttcttgtggagtgtaatcctttccttcaatttcaactttataatcagtacccatatgacgtttgatagacataattgtgttagggtttgtaatagattggcgtttagccacttcccctacttgacgttcgccgtttttaaatgcaacaactgatggcgttgtgcggtttccttcagcgttagcaataactttaggctcgccgccttcaagcactgccacacatgagtttgttgttcctaagtcgattccgataactttactcacttgaataacctcctgctatgtaattattgattcactttgaccatggaagggcgaatgacgcgatccttcagcttatagcctttttgcatttcctcaacaacaatgttggagccgtagttttcgtcttcagcctgcataacagcttggtgcagattaggatcaaattcctgccctacagcttcgatggcttcgacgccttcttttttcaaggcttctacgagctgacggtggaccatttccattccctggagcaaacttttcgtctgttcattgtcggcttcaacctgaagcgctcgttcaaagctgtcaagagccggcagtaaatcagtcacgatattttgagaacggtatttttgggacgcttccatctctaaacggctgcgtcgtttatagttttcaaagtctgcttgaacacgcaaaagtttgttttctttttcctcaagcaaaccttgcaattcgttaatttggttttgaagaagttcgctttcatttgtttcttcctgctgttcatcagcggcagcttgttcttcaatgatttcttgctcttctgtttcgttttgttcaacggtttgtttttcttctgacattgtgttcacctccctcaaagtgtaaggagaaggacaggtgctgcccttcgataaaatttgccaaaattcccttattcatcatacagacttgttaatgcttttgacaagtccgaagtcacatgctgaagcaggctgacaaccctggaataattcatgcgggtcgggccgatgatcgcaattgagccgatctgcttctggtctacggaataagaagccgttatcagactgcaattttccatctcttcatagtcgttttcttttccgattttaatcgaaattcccgtgtgcggggattgaaccagctttaaaacatcctgttctttctcaattaatgaaaggagcgaccgaactctggtgatatcatggaactcaggctggttcagcatattgattttcccgccaaaaaacaacttttcaacgtgatttgtggaatgaaatgttgaacgaagcgcgtcgagtatattgtcatagtttttaatgtgctgtcttaggtacatgacaacttccttaaatatgcgctcattcagttcatccattggaacgccgcttaaacggtcgttcagtatatttaccagtttttcaatatcagacagatccattttggtcggaaagttaatcgttttgttttccacatgccccgtattggtaacgagaatcgctaccgccatatcaggctgaatcggaatgatttgaatctgtttaaggtaattctcactcaacttcggcccgagtacgatggatgtgtaattcgtcagatcggacaaaatttgcgctgatttttgaactgtcttctccagctcgaaaattttctctttgaagatcgagtggatttggtccaggtcgcttttcgtcaatttgacgggtgacagcaaatggtcaacatagtaccgataccctttttctgacggaacacgtcctgaggatgaatgggttttttcaataaagcccaattcctccaagtcagccatctcgtttcttattgttgcagagctaaatgtgatttcatcttttttcgaaagagttcttgatcccaccggctgtgccgatttaataaaatcgttgattataacctgaaggatcagcagctgacgatttgttaacatcatcatcacctctgttagcactctcaataagcgagtgctaattctataacaaaagtatcaaaccacaagaaaaatgtcaattataactcacccaaaaaagcgccaaaaacttcattgcctaataatttcccttgatgagtcaaataaacggcagactccgaattgtgaatcagccctttttcagcgaggtcttttaacacgcttgggaaaagtccatccagggaacggccgtatttttctgcgaatcgttttttgctgacaccggctgtttttctcaaacctaaaaacatttcttcctcaatctgttcttctgttgttacttcatgtgtatctctgtacggaaaacccttttcagctatcaggtcaatgtaatgcttaacaggtccgacgttcactgttcgtgtgccgccgatatatccgtgagcgccggctccgaaaccgaaatattgttcgttgctccaatacgttagattatgcttagattccatgcctgccttagcaaagttgctgatttcatattgatgaatgccgtgagcttccatctggctcatcaccatttcatacatttcagcttcctgctcctgcggcggaagatgaagccgccctttttgcatcaaattataaaataccgttttcggttctacaataagggagtaaacggaataatgctcggcatccagtgataaagcagtgtttatggaatgttccagatgcttgagggtttgccccggaagcccgaacatgagatcaagactgatattctcaaaaccgatttcccgcgctctttcaaaagaggtgaatacatctttttgcttgtgcactcggccgattttttctaacagatcgtcttcgaacgtttgcacaccaaagctgaggcgatttacgcctgcttcttttaatatttttaatttctctgcggacaagtcgtccggattcgcttcaaccgcaaattccgataagtcgcttgagggctttagcacgcggttgatcatatctatcagctttttaagctgttcctcagacagggaggtcggcgtgcctcctccgataaagattgttttaagatcaggctgcccggtttttgctattgtatttatcatttcctgttcgagtgcgtttaaatactcgtcgactggctgactttgaataaaatatttattgaaatcgcagtagtggcaaatatgctcacaaaatgggatatggatataagctgatttcaacggattcaccttctttacagaaagaagccgcagtacaagactgcggcggcttctattgttttttcggactgtcgtccattttcagaactgccataaatgcttcttgcggcacttcaactgagccgacctgcttcatacggcgttttccttctttttgtttttcaagaagtttccgtttacgcgagatgtcccctccgtaacatttagccaatacgtttttacgcattgcttttatggtggagcgggccacgattttctggccgattgcggcttgtaccggaacttcaaactgctggcgcggaatgagttctttcagtttttcaacgatcacttttccccgttcatatgcgtaatcacgatgcacgataaaggaaagggcatcgattttttcaccattcagcataatgtccattttcacaagcttggacggtttgtagccgatcagttcataatcaaaggacgcatagcctttagtgcttgatttcagctgatcaaaaaactcatatacgatttccgctaatggcatatcataaatgatgctgacacggtttgcgtctaaatactgcatatcaatgaaattgccgcgttttccttggcaaagctccattacagcgccgacatagtcattcggcaccatcatcgtcgcttttacgtatggctcctcaaccctttcgatcttttgaggatccggcatgttggacgggttgtcgacaacgaccttttcgccgtctgtcatatacacgtcatagataacgcttggcgctgtcgtaatcaggtcgatgttgaactcacgctcaattctctcctgaatgatctccatgtgaagcatgcctaaaaatccgcagcggaacccgaatccaagcgcttgcgaagtttccgcttcatattgaagggaggaatcattcagctcaagcttttcaagagcttcccttaaatcattatacttcgctgtatcaatcggatacaaaccacagtacaccatcgggtttagcttgcggtatcccggcagcgcttcttctgcaggattggcagcgctcgttattgtatcaccgacacgtgtgtcaccaacatttttgattgaggcagtcaggaagcctacatcaccgaccgtcagttcatttgtcggagttgctttcggcgtgaacacgcccacctctgttacttcgaattctttgccggttgccatcattttgattttttgtcccggctttaccgttccttcaacgactctgatataagccacgacaccgcggtaggcgtcataaagcgagtcgaagatcagcgctttgagcggcgcctccggatctccggtcggagctggcaccttttctacgatttgttctaaaatctcctcaataccgataccggcttttgctgaagcaagcacggcttctgatgcgtcaaggccgataacgtcttctacctcttggcgcacacgttcgggctcggcgctcggaaggtcgattttattgatgaccggaaggatttcaagatcgttgtcaagcgctaagtagacattggcgagcgtctgcgcttcaatcccctgggctgcatccacgacaagaatcgctccctcgcaggcagcaaggcttcgggatacttcatacgtgaagtcgacgtgtcccggcgtatcgattagatgaaagatatattcttctccgtcttttgctttatatttaagctgaacagagtttaatttaatggttatgccccgctcacgttcaagatccatagaatcgagcaattgttctttcatttctcgttgagtgattgccgacgttttttctaaaatacgatccgctaaggtcgattttccgtggtcaatatgggcaatgatagagaaattccgtattctcgattgcctctctaaacgcttttctttatctgtcacaatctatcactcctactattaaacgcaaaatacactagcttagattatatcaataggattgtaaagattcaatgtaaaacaagaaagagaaaagttccctatcatatctgggttgcttttctctttcacgtacttattgattcatatcccgtatccattcatacattgactgggcagtattggttacggtgtccgaaagcgcttttccggcttttgaaaacatattgaatgtctccaccttttccagctctttttgtttttcttctaaatcttttgccgtgactgtttctcctaggattgaggcttctttttcattatcttttccgtcggtgagcgtaaacgcccccttcagtgaagggtcatgatagcctttcatactcagcatcccgtggtttgcctgctgcatgccgaacagaacgcctaaaaacatgatcgtgacaagcagtaagcactttccaaagtatgcaatcaaatcaaccacctatttcttattgttttttcgtctccccgctcgctgcgttgaccttttcagcatcccagtacatttcgctgaatacgtccgcggccgcgttagccgcacgctgcagctcttcgagattattatccactccgccaaactcgagcaaaagcgctctatcggttaaatcctgattgtaaacaccattatcgcctggcgagcctttggaaaagacacctgtgctaagtccggggtattttttctccatcagtttatgaagctcactcgcaattttatagttttcttcgaagtttttgctttttttcccgacgacaaaggctaccctggcatagcttttccctttaatcgttgcggttgtgtcttttttgcgccgagagtctctgtggatgtcaatgatatattgcagatttttgtttgaagcgagggcgtctttcacgaccggccttgattcatcataggacctggcatagtttaagccttttttattcaattttgactgtatatcggttttattcactgtggctccgattccctgggattcaagcgcttgtccgaacatatctcctacaagcgtgacattggctttagaatggcgcgccatgtcaggatcggtctcgccttttaatagagggagatatgattccgtattgtgcgtgtgatagataaacacgacctttttatcacctgttgtttgtttcggcggatctttttgcgcattatctgattgcgtttgctgtttttcaatctctgccaaattcgcttctctttcttcctccatcaccttagacggcggcggcgattccgcaggcatattcgtataatccgttccttgtccagctaacaaaatctcggtatcaaattgtgcaaatcctggcagctcccgaccgagaaagctccgcggatcttcgaggttaatgctcgtcgccagctttaaagaaagacgagaaagatgaaatgagctgtctgtttgagagaggtcagaagcgaaataatggttttccatctgcagcaaatgtgcaaatacgtcacccggcaattcttcagcaatcccataaaaagagtcagacgacggcctaagttccggccggagagacgtcagcacaccggatagaacaaaaatcacgataaggcttacgataaatagaaagatggcttttaccgctttccctccatttaccgcaacaacaatctgtctgtttctgcgtttatttctcattgaatccctccagcgcttgtctagtaattactctatgaacaagctagaggaagtagaactgtttagtgattgtaggagcctttgttttcttgtgacactttttcatgaagcgctgtgtttaatccgttcgctaaaacatttgccatatcgtcgataaatgaatcgacttccttcggtgtaaccattaagttgtgccctaaaggcgaaagcacctcgtgaatgagctgccgtttttcatcttcttgaagggttccgacaatacctaggaacgattggcgctgcttttgatcgggaagatcgtcttcagtgagcactttctttttcccaaacgtcatgcctgccggaacaagcgatcttgatggcctgttatccttcatttctctgccaaaatgttttaatatgtagtccaccgtgtcgctggcaattgtcacggcatcaactactgtcggaacaccgatagcaatcaccggaacaccaagcgtgtctttgcttaaatcttttcgtttattccccactccagaccccgggtgaatgcctgtatccgatatttgaatggttgtgttgaccctttccaccgcccgcgccgccaacgcatcaatggcgatgacaaaatcaggcttcgattgctcaatcacacctttaataatgtcacttgtttcgattcctgttatccccattacacccggtgcaaaagcactgacaggcctgtaaccctcctgtacgttttccggctgaagcttaaacaagtgccttgttaccaacagattttctactgccatcggtccaagcgcatcaggtgtcacgttccagttgccgagcccaacgatcaaacagctcgcatcttttgagatattaaggttttcaagaaaagctgagaattcctccgcaaagacagcagagaccttctcttgcatttccgaatcattctccctgattccctgtgcttcaagcgttaaatagcgcccttctttttttcccgaaagctctgcgccttcctttgtaacatcaactgtgcggattttaatgccgccgtgatcacgctctttttcaataaagcctttaatttcttttgtcggcacagcctgctgattggccattgcttccttcgtttccactgccaaatcggtccgtatcaaatactgattcacatccagctcactctttttcatacaggggcctccttcacattaagtacctatattgttgccatttgctgaataaatcatgctaaaaagagaaccttcaatgaaaaatactttacatttatattgcaatctaaaggtgtgtttgatagaatacaatttgttctattgtgaagaagatttaaccttaagacactgtgctacaggttgtatcttaggaggtgaaacacatgccaaacattaaatcagcgattaaacgtacaaaaacaaacaacgaacgccgcgttcataacgcgacaatcaaatctgctatgcgtactgcaatcaaacaagttgaagcttctgttgccaacaacgaagttgacaaagcgaaaactgctcttactgaagcagctaaacgtattgataaagcagtgaaaacaggtcttgtacacaaaaataccgcagctcgatacaaatcaagactagcgaaaaaagtgaacggactttctgcataatataaaaacgatcctcaataatggggatcgtttttttcatttctttttaacagctgtaaaaggaacagttcgagcaggagctgcttgtcctttttcccggttttcatctcatagtccatgacggcaagctgttcaataattaaacggagctcctcctctgaaaaaagccttgcttgatccatcgccagctttacccgaaatgggtgaacttttagattagaagcgatttgtttttgtccgtatccctgttccgcgaagtacttcgtctgcagaatcagccggaactgattcgaaataagcgccataattttgatcggttcttcattttgttttagcaaatcataaaaaatttgcagactctctgttcgttttcggttgacgattttattgatcagctcaaaaatattttgttcaaggcttctagcaacaagcatttttacatcatccagcgtaatttcttcacgatctccaataaacgtgcagagcttttgaatctcctgaaaaatcgatgacagatgaccgttcacaagcagaaccaaatgctccgccgcttccgtgccgattgttttctgctctgtttttgcaaggttgacagtaaagtctgtcgtttcctttgcatttaattccttcgcctccatcataaacgcgtgcttctttaacgctttcgtcagcttttttcgctcatcaagcttttcatacggagcaagcaggacaaagactgtgtaaggcgcaggtgattgtatatatgattcaagcgcactgacgttgtgctcaattttttcttttttcttttcacctgttaaaaaatatggatttttcacaatgacaagacgccgctcccccataaacggaaacgtttcagcatctgcaatcgcttgatccagcgggtcctcttccagatcaaaaacggatagattgaaatcctttgtctcctgatcaacgaccgtctgtctgatcctgctgacggtttcttgcagcagatatgtctcttttccgtataaacaataaactggatggacatctccttttttcaggcttttccacacatcaaataccattgttgtacgacttcctctctttcatcatccccttctatcctaaattgagtttgcaaaatagtaaagaggaagcctgactgctgcttccccatttatattaaacgcctgttcgcaagcccccgggacagcttgtaaaaaggcgataatcaccagaacagaaaacgttaccttagcttctagatttttcaaaacaattccattatacttaagtcagtcaggagggataaagttgaatgattttgaaaaaaacgttcaaagcaaacgaaatgatgctgtagattcagctgttggttttgttgtgtccttcggatttttcgccttcttgtttgtcatggcaacggttattcacctagttggttcataacagcgactgcccgggctgctgatttctcggcagtcttttttagttcgtctctgttatatctgatgtatcatatggaggatagacagaaaaggttccaactctgtttttgtatctatattggatcgttccgttttgatctgttcgcagcacgcggatagaatgtctctgtaatagttgcagaacttcttgatgaggatgatggtaccgattgtttttcccggctgagataatggccgttttcggctgaagctgttggatgaattcttcaccggtagagcctttgctcccatggtgccccacctttaagacatctgctttaatatttggaaacacgtccatcacctcctgttccccttctttctccaggtcacccgtcaagatccagctcataccgcccgtctccatccacagaacgagagaggaattatttttgcttgccggatcaggtgctccaggtgacagtacatggaactgcaaatcctttatttgcaatacatctcctcgcttcacctcttcaattgtcactccctcttctctggctgtctgcagcactttctcatctttaggttcagaaacgaaccctttcggaatcacgaggcgctttactttatgatgcttcagcagagtctccgcctctccgatatgatcttggtcagcgtgcgtcagaattaaagcgtcaagctgtttgattcccttagcagttaaaaacggaatcagcaccttttcccccagtgaaaacggatgctgtttttcgcgccaaggctctgacgagtaagacaaagtgccgccggtatcaattaagacacgcccccgctgatgcggagcacctacaaacatgctgtcaccctgtccaatatctatcatatccacttctccttcggaactaagacacggatatataaagagcagaaacagcaccgtgcagcaaatgcctccggttaccatcaactgcgacaaggagcgtttttcaatcgccataagcaataggatgatcgtgaccgtgaataaaaaaagcaaaacaggtgcaggatgtgcgatcataatcgtgaacacatcaacatctgcaatgtttgtgattagcctattggtccagcttatcaataaatcaaaccagctgaaaaacaatctcccaaacgaagcggaaagacttaatagaagaacacctgctacagctcccggcaaaatacagaaggtataaaatggtaccatcaacatattcatcggtacgctgatgatagaaaactgatgaaaatgatatagaagaatcggaagcgagcccagctgagcgatgagtgatacaattgtcagctgtcccaaggaggttttaacctgctgaaaaatagaagaggatagaattaaagaaaaactgacggcgaacgatagctgaaaaccggcttcaaagagatgataaggattgaagagcagaaggacgatgtatgaaaggcaaattgcagttgcagagtggacacgccatttgacaaggcttccagctaagtaaacacccgacatgagagcggcgcgtagcactgaaggagcagcgccggtcaacatcacatagagcggcagaaataacagcaacagaattgacgccttttctctagttataccaaggcgaatcatgatataaaacaaacctgctgtcaaaatccccacgtggagtcctgatattgccaagagatggacaacaccaagcttttgatacgcggtaagcacttcatcctccacataaaatctgtcaccaactgtaagtgcctgtacaatccctgctgaatcaggaggcaaaaggctgtttgtgaatgatatgatatgttttctcaagctgagcaccttgtacttaaaattttcaggttcgctgcagttttggatagacgtgacagagtagttccaatgaatatgctgccgataaagatactcgttataatcaaatgcacccggcacagttgcgtgattcggttcttccaatgtaccagtcaactcacatgacattcctggttctatgtataacagctgttctttttcaccagcagactgaatgcgatacgcagcagcccatttttccttatcaggtgtctcaaccatcatagacatacggtcgccgtcaattttgggaatagtgtcaatcactgccttgaattgataggttccctgccgataggaagagacattctgagaatctgtgactgcatacagtacaaaaaacaatataaaagagaagaaacaaacaataatgagaaaagcgtgcctcgttttgattaaaatgatgaggagaaagaggatgaaaagaaaaatagcggggaaataagcggcggcagtaattccaaccgttgccgaagctgccgccataggcaataacaaacgcgaattacgcattcatcacacgtagctcgtgaaaagtgtattcgcctgttcatgtatctttttcaattcttcctccgctaaaccggcatcggccaatttccctattagacccgctacaaatgaaagcttttccctgtttttcagatcaacgatcatttcatcgagttcaacctgttcaactgttacacccgcctgttcaaataattcctgcgcatacggatgtgttttgtaatcctcagcataataaaccgttttgataccagcttgaataatagatttgcagcattgaatgcacggataatgcgtcacataaatctcggctccatcagtcggcaccccaaacttagagcattgaagaatcgcattcatttcagcgtgaatcgttcttgcgcaatgatcatctatcattaagcatccttcatctgcacaatgtacaccgcccgcgattgacccgttgtagcctcctgctatcatgcgtttgtctctgactatagtagcgccgacagataatctcggacatgtgctgcgcagcgccaataaatggctttgagccataaaatattgattccatgaaattcgttccacgttgttccctccaaatgttgtgttgcctgacctttagtttacctatcataatgcatgaccgtcaaatcactttactgtaatggaagactttattttctcaaatgacttttcacctattcctgaaaccttagtgatatcttcaattgtttggaaacgcccgttttcttcccggtatgcaataatagcttcagctttggatggccccacccctgagatgccttgtaactcctctaaggttgctgtattgatattcaccagcggccccttccctccatcgctttggacagaccctccggtaccttgctgcactgctgtttcctctccctttttcgggatgtacaccactgtcccgtcctgaagaacctcggccaaatttacttgcgcttcgtctgcttgtttactggtcccgcctgctttctcaattgcctgagatactctgtcccctgttcgcatttcataaacgccaggatgctgaacagcacctttgatgtctatcacaattgtttcgcttgactcgtcgttgtttgcttcctgctttaccactgtattttctgtctctgttggtacagcttgcttcaccggctctttatttttccctgtggccagaaagatcataatagctgtgaaaacagccgcagaagccgctaaaataattgttttcttatgctgattcaaccaattcatcgtgcatgttccccgctttcgtcatattttattttcataacacatatggtttagaggataatagctcaaaggaggggaaaccattgaagataggctttatcggcacaggaaatatgggtacgatccttatcgaatcatttattgaatcaaaagcggccgatccctcaaacataacaatcacaaaccgcacaattgaaaaagcgttgcacataaaaaaccgctacaacagcatcaacgttaccgaaagtctcgaaaagctcgtttctgagaacgagatgatttttatttgtgttaagccgcttgatatatatcctttactggcaagagcgttaccttatttaagaaaagatcatattctcatttcaattacaagccccgttcaaaccgaacagctcgaacaatatgtgccgtgtcaagtggcgcgagtgatcccaagtattacgaacagagcgctggcaggtgtttctctcgtcactttcggcacaagctgcgacgaatctgcaaaaacgaaaatcaatgagctaatgcagcatatctctcatccgctgcaaattgaaagtgacatcacaagggttgcatcagacatcgtaagctgcggccccgcttttatgagctatctgattcagcggtttatagatgcagctgtcacggaaacatcagtatctaaacaggacgcgattttgatgtgtaaggaaatgcttgtcggaatgggaaaactgttagaaaccgaattgtataccttgcctgcattacaggaaaaggtttgcgttaaaggcggtgtaacaggagaaggcattaaagcgctggaaagcggtgtgcagaatatgtttcaccgggtatttcaaaatactcatatgaagtacgaggaggatatttccgcagtgaaaaagcagtttcatgtgtagacgagtatgtcatactttcgtctgtactgcaaaagcataaaaaagcattttaaaaaaccatcgttttaagaaacgatggtttttgatttctgcgccttgaaaaagaggcgttctgattgtgctgatggctcggtatccgtaaaatcagctgtcacgcgatggagctgaaagccgcagttcttaagcatttcttcgtattcttccaccgggaacgttctttgctcgtgtgtctcatcaaaacgatcatacgcttctccgttccacacaaaaaacgacatatcatgaatgacagaaagctcgtcacttccggcaaagctctgccaaatatagctgatatcttcgtcctggtcagcaaatgtgctatccggaaagacttccgcaattttataagatgaatgaacatcaaacagcaaaatgccttcaggctttaatacccgaaatacacttttaaaggtttcgatcacatcattttttgtttttaaataatttaatgagtcacagcatatcacaacagcgtcaaattgaccgtcaaagccggtaatctctctcatatcctgctgaagaaataaaataggctggctactcgataccttttgctgggcgaaagaaagcatctcttcgctgagatcgatgcctgtaacctcgaagcctttttcggcaagccggatggagatttcccccgtgccgcatgccagatcgagaatacggcctttttccgggagagatgcttcaatccattttgtccattgatcgtaaggcgcgtgtgacattaactcgtcatacacgcttgcaaagccctgataaatcattgattcattccaaagtcaagatctgcgagcggagcgtctccccacagcttttcaaggttgtagtagcttctttcatccttgtggaagacatggacaattacatcgcctagatcaacgagaacccatcttgcttcatcaaagccttccatctttttgacttgaatgccgttttcatcagcttgatccttgatttcacgggcaatagcctgtacctgtttatctgaatttccgtggcagatcagaaaataatcagcaaccagagaaataccttccatatccagtgctaaaatatcctctgcccgtttatcatcgcaagccgcagctgcgatctttaaaatggacttttggttcattcacaaattcctcctgttcagctgccagacacaagccagttatacgttaaaaatgtgtctggaaaaaccggttgattttttttcataagaaaaaccattgtatttttaatggactgaatcagcgcttgattcaaatctgtctcagcaagcttacgcacctcatcgacaccgggaaatgcccggtttggctcaatgtaatcggcaacgtaaatgactttttctaaaagtgtcatgccggggcgccctgaggtatgatacctaatggcgtcaagaatgtcttcatcttgaacccctgcctctctttggaccaaataagcgccgaccggagcgtgccagagctccggattatgatccaataaatgcgcaggcattttttcacgcgcaataatttgtttcatttcttctttcgggcggaatttggcgtaatcatgaaagattgccgctgtttccgcttttttagaatcggctccaaaacgctccgcaagttcgatcgccgtgttcatcacgccaaccgtatggatatatcggtgttcggtcaattgctgcttcacgcatgcaagtgcctcctcacgattcatataaaccattctcctctacatacttcttcactttatcagggattaagtagtcagtgggcttcttgcttttaaaccgttcccttatcatagttgatgatacctcaaattccggaacgtctgcaaagagaagcggataaggggtttcaacatgaaaaccggggcgctttactccaataaattgaatgaggttcagcagctcgtccagcttataccatttcggcaaatattcaatcatatcagcgccgataataaagaacagctgatcatttggataacgctgcttcagtaaagaaacggtatcaaaggtatatgatggcccttctctttccatttcaacaagctccagcttaaaggacggattagattgaattgcaagctttagcatttccacgcgatgaaagctgtcggtatagtcttcgttctgtttatgcggcggaatttgattaggcataaaccaaatttcatcaagccccgcctggtacagcacctcattcgccattaagaggtgaccattatgcggagggtcaaacgtgcctccgaaaattccgattttcttcatttcaaccacctttaaggaagctcgatttgtttattttcctttgattccttatataacacaatcgtattgccgattgtctgcaccaattgagagcggcttccttttacaagagcttccgctacatcgtttttatcctcttcgcaattctgaagcacgctgactttaatcagctctctcgcttcaagcgcctcagtaatttgtttaatcatgttgtcgtttactccgcctttacctacttgaaaaatcggcgttaaatgatgcgcttttgaacgcaaaaaacgtttttgtttacctgttaacattctgttcctcctaattttcctattacaatagatctcattttttcaatatcaggctcttgtccagtccacaattggaaagacaatgctgcctgttcaacaaacatgcccacaccatcgagtgttttcaagcctttttggcttgcttcttttaaaagggccgtctgtattggattatacacgatatcacatacgacggcactgctcgcggcacgctgtaatgaaagcggcacatcgtccacgttcggatacatgcccacagacgttgtatggatgataacatcatactgctcaagacgttcttctgcttcttttatgcttaatacttctttattgtgaaacgagggagtagcttctgtaagccgctttgctttttctaacgtccggttgcaaatgtcaaattttttcggggtatttcggacaattgttgtaaaaatggctctcgccgctccgccagcgccgatcattaagaatgacagttcagagatgggcttgtctaataccttcattaatgacttcacgaagccttccccatcggtattgtatccgacaagcttatctccctctcttctgaccgtgtttacggcaccgagcacttttgcactctcatcaatatgatccagataatccataatggaaaccttgtgcggaacagtcacattgattccttgtacgcctagagctcttattccttttaccgcatcctccagatcattctcttctaccttgaaggcatgataatgtccgtcaagcccgaggtctttcaatgatgcgttatgaatatcaggtgacatagaatggccaatcggatttccgataaccccgtacagctttttcatactcctctccccttttcttaaattaatgaacgccgaacaaatacatgaacgccttttggcgcgtatgcagttacctttttatcggcgtcatggacagtaacccagcctaacccagagaaaacgatatctgtctttttgtcttttatcgtaaacgtatgggcgaccaattccggaaactcatccatttcatctttacccggaggtgtgagcaattcccctgcatgcttttcataaagcgcgtctgcattttcaagttttgttctatgaatcatcagttcattcggcatatagcaaataaaaggagatctttccccagacacataatcaaaccttgcaagtccgccaaaatacagtgtttgctgatcattaagctggaatgtgcgaggcttcagctcctttttaggagataatattttcagatcctttttattgacataatgcgccatttgatggttgttgataattcccggtgtatcataaagcgatgaaccgtcatccagcgggatttcaatcgcatcaagggttgtgccaggaaattgggatgttgtaataatatcttcttcacctgacacttctttaataatccggttaataaaggttgactttcctacatttgtacatccgacaacatagacgtcttttccgttgcggtaatgctcaatcgcgtcaattacttctctgattccctggccgcgtcccgcactgaccaaaaatacgtcaaccggttttaagccaagctctttcgcttcacgcttcatccattggatcagacgctctcttttcagtgacttaggcaaaatatccgctttattgccaactaataagatagggtttccccccaccaagcgctgcagcccattaatccagctgccgttaaaatcaaaaatatcaacaatttttacgacaagagagtccgtttctccaataccgtgaagaatgttcaaaaaatcatcatcagttaaggagacatcttgtatttcattatagtttttcagtctgaagcaacgctggcaaatcacattttctttcgtaagcgatgcaggcggcgcgtaccccaaacctgttttgtcctcggtttggatcgtaactccgcacccgatacaaacaaccttttccatttcttactcctcccactgaatgtgcccttttcgtttgagagcactcagtattctgcgttcgacctggcggttaaagcgcgtaatgaatccgtcagaggaagcgactggcacgaccaaaatcgtatggtagccgtttcggtttcccccgagtacatcggtcagcagctggtctccgatgacaacgcagtcctcttttttcagctccatattgcgcaccgctctattaaaggctttacccatcggttttcttgctttatagatgaatgggattccaagcggttctgagaaaagtttcactcttctttcgttattattagagacaattgtcactttaatgccgtgttccttcatttcttcaaaccactcgatcaatcgcggcgtcgcgttcggcctgtcccattcaacaagcgtattatccaggtcagtaataatcccttttacatttcgttcctttaatttctcaggtgtaatatgaaaaatattttttacaaactcgtcaggtaaaaaaaacttttttaacaaaacccgcacccttccctttttctttctttcaaaatgattgtcgaaaaaaatcgaacttgcgcctaaagaaaaactgagcaaaaaaatttcgacaaaaattgggtttcttcaccaggtgtggataaatttacacacactatccactcttattacatcactctttagacaaattataaacacgatactcacaagttatccactttttggtgtggataacagaacgattgttcttatatgcatttcatggtagattaaagataacttcaacctcagatgaacgcaacttatcattgtatgcgttaaaatcatgaatgattccaacttttaaggaggtgcctctcccattaattgggttcctagcatgagaaaactgtctgatgaattactaatagaatcttatttcaaagccaccgaaatgaatttaaaccgtgactttatcgagttaattgaaaacgaaataaaaagaagatcgctcggacatattatttccgtatcttcttaataggaatttgtctattttttccgggcgtatttcctttttttactcagatgactgatattatatcactttggctgcgcgctttactactattttcagcaaaaaacacccctaaaaagaggtgttttaaagggccggttattatgctaaccagtatatgccgcccacaacaaggagaacaacaactaaaacaacaataaaagcgtatccatatgctctgcctgcgccatacatgtgaagcgcctccttaataaggttttataacagcctatgtaggagaaataaatcggactaggcggttgtccggctcaacgctgcaggatctgcccatcttgtattccttcatatacgatccttgcccctttaggtgtcatatgatttccagaaggatctataagaccagattggataagcgcttcatcagttgcttttccgccgtctgcttctataaaatgcttccagttatctacaagagggacatccaggcgcttcgacacatctcttgtaatatcgttatatgagttgtgccatttccttgctccgccttttggttcaaaagcagctgcttgatatctggaatagtaaaacaaatgatgcttcccattaccttctataattgggatacacgtcattaagattggcttgatcccgtgttttctgctttcttcaataaaataaaccagattttctctaaaacgctgcttcgacactctcggtttcccctcagtcagtatggcagcgtcattggtgccgaacataataaacaaatacttcggtttttgatccagcacatctgtctgaaatcggagacgggcatcctctgtcgtctgtccgccgattcccgcattgagtatatcaaggttaccgcgctcagctgtttttaatatattgacccactgctgtgcttttggataatcgcgataatcccaattagagccacgcgtattgctgtcaccaaatgctacaacgtcttcgtatccccttccctcgcatcctgctgtaacgaacagcagaaggaaaaggatgataaaatgtttcatctttacacccccaaaagcctcaccttaatgttatacctctgtttctcttcgttcaatgaagagtttttcgctatcactgttttttcctatagttaacgtgtccccctcagtgaatatcattctgctttcattgcggcgcagctgatgattttttaaaattcccttctttccaatctgaaaaacacacaaaccaaagaaaagaaaataacctaaatccgcactggaaacaggttatccgttaaatcctgcatttactttaacttcgatttaagcttggcctttgtttttggcccataaatcccgtctgcagttaatccgttcatgagctgaaaacgcttgacggcattcgctgttttcggtccgtaaactccatctatgccattgtttttggctcccttatcagggtaaaagtgaagtgcagttaaagccttttgcagctggagaatgtttgtgccctttcgataaggcgaagtgagctttataaccccagacggcagaggatatgatggtaaaggttcttttggaggtgtatccgaggaagaaattccgtttataaaagagttccagtggttcaagagtttccgcggacattctttcccagaccattttttgtggggaacaacacgatgtaacggaatattgttttccttcatcagctttctgatcagccactgggcatttgatgttgctttttcaaaatcgccatcagcattttcgcagatttcaatcccgatcgatttgcggtttcctgtcccgtttgtaccgtctcccgcatgccagccgttttcatctatcgggagatgctgataaatgactgaatcgtcaactgtaaaatgccagctttcggatgtgctcgggttttttacaaaattggcgtgcattttcgcatcagcgccttttgctgtattcgctgtattatgcaccgtaatataagcaggcgtcatcgcatagccaggacgattatcatttgataccggtataaaatccttttttatggttaccatttctatccctccctattattaagaatgcagaaaacagagagatggacagccttttttatgaggtaaaaaagaattgtgttctcaacctggttttcagttgaaccgctgaaatggcaccagttatactaatttagatgacggaggttttggctcctgacatcacctaagttgggagtgaccatagacatgttaaaaaaagtaataggtatacttgtgattatcgctatcattgcagtcggtttttttcagaaagaagcttggcttgatgcaatcaaagcaggagggatgttttccgttttatttagtatgctgctgattgctgccgatgtttttttcccaatagtgccgtttgctttggttgctgctttaaatggcgcagtgttcgggactgcaaatggaatttggattacactgaccggctcaatgcttggtacaatattgctgttttttctcgccaggtacagttttagagattgggccagaaaaaaagttcaggcctatcctgccatacaaagctacgaggcttccttcaacaaaaacgcttttaccgctgttttattaggaaggctgatacctgtcataccttcacttgtaatgaacgtgatctgcgggctgagccaggttcgctggcatgtttttttctttgcgtctttaatagggaaaatccccaatattgttgttgtcactattgcaggtgccaatttcaccagcaataaattattgtctatcagcatttacggtgcatatattctgatcatcatgctggtcatttataaaaagttccctcatcttctgaaggtgccaaaaaaataaggaggcttgttggcccccttactttttttctgtcgcatggcctccaaattcatttcgaagcgcagcgaccacctttcctgtaaacgtatcgtctgttaaagaacggtatctcatcatcagtgacatggcgatgaccggagttgccgtctgcagatcaagcgcggtttccaccgtccattttccttcacctgaggaatgcataatgcccttgatctgatccagtttcgcatccttagcgaaagctcgctcagtcagtcccataagccaagaacgaatgacagaaccatgattccacactctggcaaccttctcgtagtcaaaatcaaattggctgttttcaagcacttcgaatccttcaccaatcgcggccatcattccatactcaattccattatggatcatttttaaaaaatgtccgcttcccgcttcaccagcgtatagataaccattttcgacggcagtatcacgaaaaagcggttccacaatctcccatgcttcatgatcgcccccaccataaaacaggctccatgccgtgcgccttccattccgcccgacgttccggcatcgagataatggatacccgcttctttcatttgattgtagcggcgaattgattctttataatgagagtttccagcttcgataatcatatcgcctttacttaataaaggtgatacatcacgcaaaacagcatcgacaatgccatgcggtaccataacccataggatacgcggcgggtctaataaagaaattaactctttaagattcgttgtcccctcagccccgtatgctttcagttcatcaacagccgcttgatttacatcatatccaaccgcttgatgattgcggtcaatgaattgctttcctatgtttatgcccattttccctaagccgattaatccaattttcatatctgttcctcctgattgtctaaaaagcctttactctttatgttccctttggattgtattgtgatacgcagaaaacaaatggggcttacatcgtctgcgcatgtaaattttatttttcatgactgactgtgcctgccagttctattactgaatctctttatatccataattatcactttatccttgatttaccatcagtttaagttaaaatatgggaaggtattcgatttttttagtaaaaagaaggtgacatgttgcagaatcaatctcatactcttatcggagttacgaaaaccgctgtattctttttatacgctgcacttgcaatcatcggttttgcaatcgggtattttattccgcagattgcgaaatgggcattatccctcccctggatccctcttgaaggaccacttcggctcattacctcttttcagggatctacagcttcatttatcactgctcttctcggtatgtgtgcggggatttggttcgctcattctgttattgcaatgctgctgtctgtcaaaattacagatcacacagtggaattcatcaaaggaaaaaaagtgcaaacaattcattccgatgacatcgctcttgtatttatggatcacaaacggcttgtcctcctgggaacagccggatatgaattggtacgggaagaaattgatgaaaaaccagtaaacgttgagaaggcctttagacagcatcattacgaatgggcaacagatggtgatccgtttaaagatcaatttcgccgatggattcctgatgcaccagacctatcgcaaggcgcccatgccttattaaaagctcgtcacaaagcactgcaggacgaagaaaaagacgatattgaagaattccgtctcgaactggcacagctgggcatcgttgtacgggacgaaggcacacgccaatattggcgaaaagcagaaacctatcccccgaaaattcagctcggcgaaggattgtaacaacagaggctcaagaaagagcctcttctttattactgcacaataaacagcactctggtgccgtcagggtagctgctcatttgattccctacccacgagccggcgccgcgattatcagaaggcgtcacatatcggacatcagcccctgcaccgccttcctcgcagaccgccatcggccactcatcccggtcatagcccggcttggtcgggattccctttaaagattcctcccgccttttgtctgctccatctctgtcaatggtacaaatatctggatgtccctctgcaatcgcatccctaatatgactgccggtttccggataacgagacagcggaaaatataacactttgtcatacgaagatgcgccttggatctgttgcggaaccattaaacaaagaagaactgctgcagcaagaaacaggcctgccatccattttttcattcccatccccccatacctttgttcatttcaatgtatgggcgcttgatgaagaatatttttaacatttgaagttagtatgctgcttaccaaagccggactcccccgcgagaaatttcccggtacagacacagacagcctcccggtcacatacatttacatataggcttttgcctacatacttttgtggaggtgacgatggtgacaggtgttttcgcagcgctcggctttgttgttaaagagcttgtctttttagtatcttacgtgaaaaacaatgcctttccacaaccgctctcaagcagcgaagaaaaaaaatacttagagctcatggctaaaggggatgaacatgccagaaacatgctgattgagcataatcttcgcttggtcgcccatattgtgaaaaaatttgaaaatacaggtgaggatgcagaggacttaatctccatcggaacgatcgggctgataaaaggaattgaaagctattccgctggtaaagggacaaagctggcgacgtatgctgcgaggtgtattgaaaatgagattgtaattacaaaagggggtgcatactcctctttaatacgtttaaatatattcggtgatctcttctcctctcttggtttattattgaaacggaaacaaaaatccattacactattgctgatgcaccaacgggtgggaggactcgccatgaacaaaaaagaactgctcctaatgaatttcaaggacttgtttaacaagatggcttggcttaataagccaaagatggaagtctgtcttaaagggtataagccttctgaagtacattgtatagaatccattgaacatggaaatactaatgtgacaaaactagctgagtccctttatatgacgagggggccataagtaaaatgactaaaaagcttatagaaaaaggcttaattgaaagctaccagaagccagataacaagaaagaaattcattttaggcttaccgagcaagggaaaaaaatttataaaatccatgatgaactgcacaaagagtttctagagcgcgacaaggcagtatttgaacaagtaaccgaggaacaatttgactttatgattaactttgcggaaaagtataatagacatttggatgtagaaataaaaaaacaaggttttgatattaagtcggaataaatttaaataatgaaaatgcaaccacaggcagccaactctattgagtttcggctgcctttttattaccgtcattttgttgacgaggaaacaaaattatgttattttttgttgactgggaaacaaaaaatacaacttttgagaggtgaataatatgttaaaagacaaagtaaaggagccaggattaccaaaagaaatcctcatggcttcctgggccattgcacttggagcaattgccccaatgcttgactcaactatggtgaacattgccatcgacaaattaaataaggatttcagtacgacgttggataccattcaatggtccattacaggttatgttttagctcttgctattgcagttccagtatccggatggcttatgaacaaatttaatggaaagaaaatcttaatcggcgcagtcattgcctttggtgtaacttctgtttttgctggaattagttgggatgtttctagctttatcttattccgtttgcttcaaggatttagcgctgggattattactccgctcatgtcaacactcttggttaaaacagcaggtccagagaatataggaaaagttatggctatcgtcagcacacctatgattttgggcccaatcttaggacctgtaatcgggggcttcatcgttcaagctacatcatggcattggattttcttcatcaacgtgttcatcgttttgattgctgcaccactgatgatgaaaactcttccagactttgagccattcaacaaaaatagtaaacttgatatttttggaattatcaatctatccttaatgagtgcagcaatgatatacggaattacaaaagcagcagaccatgcatcatttaacaatagcgaaacaatcctatgggtgggcatcggcctctctttagctgtaatttacatcgtatataatcgaatcagaaaaaatcaaaccgtactccctttaaatttgtttgcacacaagaacttcttagcatccagcgtcgggttattattagcgaatattgccgtcatgggacccatgttaatacttccattgttctttcaaaacttccgtcatttcacggcaatcgaagctgcgcttgcattaatccctcaaggagttgggatgctcgttactcggccaatgattggaaaaatgattgataagatcggtgcaaaatacgtggttattgtcagtctcgtcctttcgcttatcggatctattccgcttatctttatcaccgataaaacaagtatgatttggatttctatcatattattcatccgcgggaccagttttggaggaattatgcttccgttaacaagtgatgcttatacaggacttgacagcaaacaacttccagaagcaggtgtcggtattaatattattgaaaacctcggtgcaagttttggttcagctgttatcgcaactgttgtcgcaactactatacaaggattgcaaccaacgattgcgaatggcttaaaaggttaccatgccggattcttagtatccaccattgtccttgcggtaatcttcatcccaagtctatttctcacacataaaaagaatgcacaataaagaaatctgcatactcgactgccgaacggtttgtttggataacttgtgatacatgtgatgtgcaccagtttcataagcccatttagaaaggcgcttactaatttgattggctatctgttttcttcgatgtctggatctacttcagaggtttcaattacaaaaagagggcaataaccctctttaatacgtttcaatatatatagtgtcagaatccacaacggtaacttctttcacgataaagttaacaattgtttttttatcatcaagggttaagttatctgcaccgattgattgaaaatagtcgatggctctttttagagcattttcacttgagctcgtatcatccaggactttcatttttgattgaatttcgctacacttttcagtaagctggttttgctttttttgcagctcaataatttgcgctttgatttcatctatgtctaaatcatcgtcatcgcttaggctgattagcgttaaaagacgcttgcggcctttttttgttttctctatctctttttgaataagttctaattcatcagacaggtgatttgattgttcaatctctttgaaagaagcatacttttgaggatttgtgatgaatttaaaaatttcaccccatacatgccggttcaatttattctcagacatttcctttccgcagccgcggtcctttgcgccagaataatttttccggcaagtatatacatagtagtctttaccatgtgattttcttttcttccctgtcatggtatttccgcatttcccgcatctaaccaaacccgataacaagtaattgtgagggctaatgcttaagtgttttcttttactttgacctaagagttcttgagcataatcccattgttcagctggaacaattgctggaattgccacagtgatttgctcctcttcaggccttattttgattatagatttgttccctgcctgttttgaaacataggaaccctctgtatcatatttatactgtttatgttcacccttataagaagagttcattaatatctgtcgaacaacctgcctgtgccatactttggcacctttttttgttttaacccccatctgagttaaatgtagagcaataccatttactctgccgaaaaaagggcttttatgatcggtgaaatagttaaaaatcatcctaatgatttttgcttcctcttcaaaaatctcaagagttcttttctctttaacaaatttatagccatatagtttggaatctttaataatcatgccttttttcattttttgaagtcggccgcttgatgtccgttctttgattttggctttttcaaattctgagattgctccacgcattgcgaaaaataattgaccttctggagaattggcgtattcaccatttacaaataccaagggtatatttcgctttcgcaattcgtcatcaatgataagctgattcattaatttccgagaaagacggtcaggatcataacaaatgacttgacttataagtcccttgcttgcatcctccctcaagcgattcaaagccggacgttctaaaagctccccagaaaatccttcatcggcatacttcagcacatccttagtccctgctttctttatacaggcctcgatctggctgtcgatgctcgatcccttgatcgcttgttcctcggtcgatacccttacatatattgctatcaccctggatctccttcctataaagttttattaaataatgatagcaatcgttaatgcatttgtcagcttgcggtccctcgatgattatcaccttcataaaatgcatcaccccttgggtaatgctatgtaaaggcggtttgtcctaatgaaatcattttcaatgagtgtgaaaaaagcacttaaaaaaccgatagttaaaacgatcggtttttcgacatcgcctaggccctcaacatagtaaattcatatcattagttatgaaagcttattttcactacactccttatatttaattgccatcatttctatacgatttatatgaaatatggtaaaaaatggttagctaaaacgataaagataccaacctgttcatttggtatccccattcttcaagtacctcaataaatgtaaaccactgaatatttttatgacattgcacgtgtcaatgatgccaattcatgaactcataaaggagatttaataaaactcccaaaacaaaagggatatcaatatagttggtatcttctttattagtttgaatccctcaataaagtggatgcttatcataattacaaaaaactttatttgaagcactgaagtcattcattatattgttgtaaagataacactatagtccccttcttacttcataaacggttgttatatttaacttcttaattaagggacattttctgtttttagattcgttatgtctttttctgttacgtaaagaatggagataaaccaatagaattaagtgagctttaaatgcttcaaaaagctctgataacaaatctctttataatattcatgtgaatttatatcttcactcattagccattgaatgagcaatccatctacaatagatcgcattgtttttgaagctttttcaacatctatactttggtcaaatacgcctgtttcctgtccgaaaataataatgttagatgtggtgccccagcactgttgataaaagctatggttaattttcctgtacgtttcatttcgggttgcctgagacaagaaatctaaataaaccttataaaacttttcattttcctcgggagagacaaatattgaatttacataagctttcaacttatctagtggcgtagattccgaatccactgcttccaattcatgtttataaattttatttgtaagccactcaagtagttgagaaagggtatcttccttattatcaaagtaataatgcacgacgcccttactaactcctgcgtgatctgcaatactttgtagtgtaactgaattataaccttgtgttgacacagcttggaaagctgcccttaatatctgattctttctttcttctgcttttttcttcataataaacctccagaaagctaaaccttcaattagtatacaacagttcatgaaatccacacaaaattattccgaccagacaaaatagtttgaccggtcagaataatttagtatactaaaagtggtttcacatcaagatagcatataggaggatttataaaatgaaagacgaattcaaggctctagttgtaaacaaagttgatgatgaattttcaattaaagtaaagaatgtttctccagcgtttttaccagaaagtgatgtccacatccaagtacactactctggaattaactacaaagatggacttgcagggaaccccaatgggaaaatcgtaagaaaatacccatttataccgggtatagatttagcaggtgtagtcatttcttctaatgatcctcgctttaaagagggggataaggtgattgccacaagttatgatataggtgtttctcattttggcggttttagcgaatatgcaagtctccctggagactggattgtacctttacctgataatttgaccctcaaagaagcaatgatagtaggaacagctggcttcacagcggcactatctattcaacgtctagaagaaaataacctatctcccgaaaaaggaaaagttctggtaacaggagcaacaggtggcgttggtagttttgctgtttcattccttaactctctcggttatcaagtagaagctagtacaggtaaagaatcagaatatgattacttacgaaaacttggagctagtacaattatttcacgggatatgacctatggagggaaggttaaagccttaggatcacaaaaatgggcggcagctgttgatcctgtaggcggggaacctcttgcctctatcttaagccaaattcaatatggaggttccgttgctgttagtggattaacagctggaacaaaactgccaactactgtttttccattcatcttaagaggtgttaatttacttggaattgattctgtatattgtccaatggaaacacggttaaaaacatgggatcgtgtagcaacagattttaaaccatctaatttaaaggaatttatatcacaagaaattactttagatcaacttcctaacgttcttcctgaaatattggaaggacaagtaagagggagaacgattgtaaatatcgtatgattattcatcagaactcatccagttgctaaagatgaaacaatgtcttaaaggtctagtaaagggattctcaacaggaattcctttacttattatagcttactttatgttaatgcaaaaatataaggagtgatcctccccattcagcttacacagtcttaatgatatgaaaacgcttattcatcgtacattataaatgtggctcctagtctggagtttcgttatgggcaaacaaaactcaaataaataggaacccaccttgtcacaataaactcaatagactaatgctgagaagtctccttacttacttcaacatgctcaaaaccctgtaaacaggttcccttggggagaagaaacatttgaaaaagcgaaacgcgaaaacaaacctgttctcgtatctattgggtatagctagctcgggtagctatacgcacatgtcattggtgccatgtttcttaaaataaccacaaaaggcaaccagtttcggctgccttttaataattttattggaaatttttagaaagctagattcaaaaactttttctcttctaatttaaatactgttgttttttcttttgattcattccattttatcttgccctctaatttgtgtcacttaatatcttcctcgggcatataatcaaaagttgaaacgtgattggtttttttcccaccgtctacaaaccgcgagttctgctgattaagaaatggaaagataaaaagctagatcaaatcatagaaacaccttattattgcctttcaaaatcctctgcataaatgaactcaactttttgactgctctcttcgtattccccttaaaatttaataatcactttcccttttggccgtccatttgcgactagttctagcgcttcatttacgttgtctatggtaaatagtgttggatgaattgctggaacaatgttgttttcttcaatgattttagtaatctctttaagttgtgcaccgtcagaacgaacgaagataaaatagtatcctacgttttgtttcttggctttgcgatcatactttgcgcccgcaagggaaaatagcatttgtttccacaatggaaaatttcggtcttttccgaagcgtttatttggtcctgtacggagagagagcaatcttccgcccgatttgatgatactcaattcactgtcaaattctttaggtcccagtgtatcaatcacgtaatccacattcgacaacaagtcaacatagttttctgttgtataatccaaatattggtctgcacccatttccaaagtgcgttcgcgcgcctctgagctgccgctaacaatgacatttaggcccattgcctttgcgattggtacagccatttgaccaaagctgcctgatccacctggaatgaagacagatttacctggctgtgcctcaagttcttcatgcaggccttgatacgctgtgagtccagccagtggtgcagcagcggcttccacgtaagacaaattttttggcatgggtgcaattgcggcagcgtcaattgcggcatattccgcaaaagcaccaattttttcgagggggagacgtgtatagatggcatctcctacgtgaaattctgttacattttttccgactttttcgataactcctgtcaattcattaccaagcgttaatgggaattcataatcttgaatcagtttcacgctgcctgtaattattaacatttctagtggattgactgccgcagctttgacctttaccaagacttcgttttcatcgatttctggaattggaatgtcattgactttggcatggatattttttgaatacttggtgatctgagctgctttcatgagtgttttcatatttttatcagcatcctctatcatattacatttattaggtttttacctttttatataatcgtttaggtggaggggaatcttactttaagcgaagtctgacttccaattttatgattaacccgccacctaaacattcgtgatttttagaacgatcattctcaaatgattaaattttttaggtccgatactgtaaataaatgtttctcatcttcctagtgttattgatatagaacatcgttattatatagatttaataacttgaaagattacatctctagaatcggatagatttgatctcttaattgaaattcatagttttcgtctacaattcctactacttgattactatcataaagctccatcataaaactcgccacttgctcaactgtgtggtacatcgggatatttgctttgtaatcaaattctgtcgtatcagatgcatttttcatgaattctgtttccgtgattgctggtgctaaaactttcaccttcattttcgcacctttgcgttccagttcttttgcaagcccttctgtaaatgcactaacaaagtatttagatgcagaataagtaatactgccaacagcaattgcatatccgagggctgatgatacgttaattaactgagttccctctacatccgaataatcacgtacaaatagtgtagaaagaattgttaaggattctacgttgacacgtaacatggtttccactttatctaaattctgatccgtgacagaagaagattcaccaagcccggcattattaatccaagtctcaatttgatattcctttaaattatcatacagtgtgtatgcctgagctgtgacagataagtcacatgtacgaatcataacatccaaatcgggattaatattctgaattgttgatttaagctcttctaatttatctaatcttctagctacaataattaagtttttgccgcgagcagctaacgctaatgctgtctcatatcctatacctgagcttgctcctgtaataactgtatacttcatattattctctcctcgaaaacaaatttttttttattagatcatccatataacaaaatagattcagtctaatgtcgacaaagtcaaatcaataatgttttctaatttttcctcatcatttgtcgtttttgctaatactcgtatccctacgagtgaattatgaataaattgagaaagccctttgatatcatagtgtttagaaatttctccttgttcttgaccatgtttcagtagatcaaataagaaggtttctgtctttataaaagtctctgtaacttttttagtaaacgatttattccattacgagatcttggctagatgacagatcataatcaactgccactacactcctggtcaccctcaattaggtcaatgccctgttctttgctgtgtggatctgaccatacgggtcaccattttgcgcggcatcaaccgtggaaggaatgccatgaatcggtttcgagccccgggcattattaacgtcttgccacgtaagaagcctcggtacccttcctcagccacctgcccggcctccatgatagcaccactctggaacaacttcgattcaccaatacccgaacgatcaacgaagccggttgacgtcagtcccggacatagagccgtcacagtcacccctgtaccgctcagttcgttctccaaagcctcggtgaacgacagcacgtacgccttcgttgcgtagtaaaccgacatcataggtcccgggaagaaagccaccaacgaagccacattcatcacgcctccttggccccgtttgaccatatccggcaagaacagtttcgtcataacagtcagagccttgatattgacgtcaatcatattcgtctcttgttctaactgcgtctccaagaacgtcccgtacaaaccgaagccggcattattgacaagatagtcgacgacgatccccttctccttgagctccgcaaaaatctcctccggcacaccgggtgacgccacatccttggcgatgaccgtcgcttgactgccatatcttttccgatattccttcgcgagctccaaaagcttaccctcgctacgcgccaccagcaccaaattatatcctcccttggcgaaacgatccgccaactctttgccaatcccacccgataccccggtgataagaacagtttttttcatttgacagcacacctccatttttagtttgaacttttaaaacgttttacagcgtttcttactgcgagtttttactatggatgtatgttatccataattcaaatttttgtatcaagaggatttatacttgccgcatatatctcaactaagacctcgccattatttattttgggcctagggaagtaaaaatttggtttttcgccgtagttttcaatcgctaaagctttcgttacaatcctccacatttttatttaacgcacatgtatcttttcctaacgaacctaagaaaaaagaatatgaatatcccttccctagatgggatattcatattaaataaattattttaagaaaggataatctgtataaccttcttttcctcctgcatagagcgtgttttgatcaggttcgtttaggggagcacctgatttaatccgttctgcaaagtctggattagctagtacccaagtgcctactgtgacaacatctgcaagattattatctacatcagacgaaagttgatctagaggacgacctggacggttaacaagaagtgcttgatcccaaagttgacgcacatcttttaggaattgctcgtttccaaagtgcattaaatgcagatatacaaggttaagcttatttaattcacttattaaatagcgatacatctcaaggctattttccccttcatcaatgccttgcagtgttccttgaggagaaaaacggatgcctgttctttctgctcctatttcatcaacaactgctttagctacttcaattgcgaatcgagaacgcccctcaatcgtaccaccgtatgcatcttgacgatgattggagttttcactaaggaattgttggatcagataaccattcgctccgtgaatttcaactccgtctgcaccagcttcaattgctgaacgtgctgctaaacgaaactcattgataacatcttttatctcaagctcactcagttctcttggtgttgggacttctttcattccttctgccgtgaaaatttctacaccaggtgcaatagctgacggtgcaactgcttggcggtggtgaggtgtgttatcagggtgtgatatacgtcccacatgcataagctgaataaaaatatgaccgccttcactatgaactttagaagttacttttttccaccctctaatatgattttctgtataaataccaggtgtattagtgtaaccttgcccatcatctgaaggttgggttccttcgcttataattaaaccgactgaagcacgctgaccatagtactctgctactaaatcgctcggcgtaccatctggtaaagctctatttctagtcatcggagccatacctatacgatttttcaagtcaatgtttccaatacgaactttttcaaataatctgctcatatgaatactcctttttaataaaaattagaatcaagaaataaatttacgtgttctgcaaatagttctggaaattgaaacagatgcccgtgaccagaatcaggatatataatcagctgtgctttgggtaatttctctgctaagatgtaactgtttttagttggtaccattacatcattaacaccattagtaacaagtacagggtgtttgatgttttgtaaccattcataatcatgattagatttttgtttagcccattttgcaatggcttgtaattgtgcctcttttacttgttctgaactgtttacttttttctgattaaaaattctttgtagtgaagccattcctgcagatttacttgtttcggtttgtgcgtagaaaaagaacataaaatcatttattccatcttcttccgttccgccgtgacgattcattctttcaaaaatctctggatttggattaataccagattcaggcgaagtacctgccataataatttttcttactaaatctccttcttgtaaagctagctcttgtgcaaccataccaccaatggaaaaaccaagaatgtcaacttgttctaatccaagagcttttataaatgttgctgtatcttttgccatatcagtaattgtagtaggcgttattccatctgtctcaccaacccctttattgtcaaataagattactgggcgtttatttgcaatcggttcaagcatgtctggatcccagttttccatcgttcctctaaagtgaacaagaaatactagcggtataccatcttgtgtaccaaattttctatatgcgtaacgagttccatctgcttcaataaattctgattctgatggtattttaaagtttgtcatttttgtgttcctccttagaaattaaaaaacgattttataagtatgcattatgatggtttgtttcatgctaattttagaatgaacgttctaaatagggtaaaaaaaagaaagctagtccaacactgaaagtgctagagtaatgatgccttctaattcttttttactgtaattagtttttattagtactcttatacctaccaaattgttgtgtaagaaacgagatatgttatcagaatcgatttcttttgatatctctccactagtttggccccgttttataaggttattaaacatatcttcagtacggttaaacatttttgtaactatgcgtccaatttctttgtccaacaaagataattcaatggctgcatttactgatagacaaccttttgggtattgttcaatggaattcagtacgaaaataaaaacatcacgtatcgcctgtttaatggatgaagttctgctaattatgctttccatctcattgacgacgagctcttcatagtgattaagggaagctaaaaacaatgaacgcttgtcaccaaatgtgtcatatatactcctgcggtgtatccccatatgatttaccaaatcttgcatggatgttttttcataaccctgttcccagaaaagctccattgcttttcttaatactgctttttcgtcaaactctttacttctagccatttttttctccttaaaaaaatcaatgaaccaatactaacaaaaacaaaagtcataatccattgtagaatgaacattctaaaatgaactcatgaatttcaaaccatgattaaataatatcctttttagaacgataagtaaagaattataaatttaattatcaataatctctggaacaatgtgcattctcatttgagtagcaaaacagttagatctaacgtgtttcaagtatagcaaatttgagaacgatcggtaaagaatttataattaatcatgtgttttatatggctatgcgtagcctgaatttttatgaatatcgttccattttatctctactcaaatcagttctgcaatgtcactggtggcataggatcttttttatattagatgcacacaacaacttcatccaaatacaaaaaacgaatgggaactatatactagttgtttttttatttacagtctaaacaaagtaaaggaagtattacttgaataacttcttttctccaaacgatagctagccttggcctattctaaagaacattgtcatttttgcaaattaggaaactaatttatcatagctagccttcaattaaacgttttaacttaaactcagtttcagtatcctcaactggagtatagacgctgcatcttaaatcagtatccccatgcacttgtaatgaagtaagattaaacaacattttacctaccttagcatgacgaaactcaattaatacttcaggagcagagcttatctcattttcgttccaaattttacgaaactcaggatatgcctgttccatttcttgtataaattgctcataccagtcgtcagccacatactgtccataatacgttctaaatattgcgatatatcctctaacaaaatgctcccaattcactgctaaacttttaaattcctttcttgcgaataataagcgtattatattcctttctgccgggatgatttgttcaaaatccaaaaatacattagctgctgcttgattccatccaacaatctgacttcttctatctgatataatcgttgggcaataacgcagttcctgcaaaatttttactaaagccgggctgatttccttctcattctcatttctaaaaggttgtttcactccttcctctaatgctagagcatacaaatatctcctttcatcgttatttaattgtaatgctctagaaatagcatctaataccgaagtagatacttttatatctctaccttgttccaaccatgtataccatgtaagacttacaccagctaattgagccacttcttctcttcttaatcctggtgttcttctgcgggttcctacaggtaaaccaaccatttgaggagtaattttcgaacgttggttctttagaaattctgataaagcttgaagtcttgtttcaggtttcattaagatctccctttaaaatagtattaattatactaggataaacaacaacttgtaataggataacacaatagctaaagttaataaaaacaaggagggaattatcatgaaaagagttgtcattactggaatgggagttatttctccactaggaaatgatgtaaatagcttttggaatcaactagttaaaggacactcgggaatatctctaattgattcttttgatactgctttttataaaacaaagatagctggaatcgttcgtgatttcgatgcagatgaaatattggggagaaaagaagcaaaacgattagatcgttttagtcagtttgccttagcagcagccgaacaagcattagaacattcacaattacagttagataaggttgatcttgaacgtttaggggtatatgttggttcaggaatcggaggcatacaatcgcttgttgataatgtgaatgtattgaataaacgaggtcccgcgagagtaagccctagccttgtaccaatgatgatttcaaatgcagctgcggcccaaataagcataaaattaggagcacaaggaccatcattatcaccagtcacagcctgttcaatcgggaacacctctattggtgaagctttcaatgctatccgaaatgatgaagcagatattatatttgccggtggagcagaagctgcaatcacacagatttctttggctagttttggaaacgcccatgcactatctacaagaaaccaagatccaagtcgggccagccgtccgttcgatacagatagagatggctttgttatgagtgaaggcgcaggtatcttagtattagaatcattagaaaacgctattcttagagatgcgccgatattatgtgaagtagtggggtacggagctagttcagatgctcatcatatggtagcatcacacccagaaggtaagggtgcctacttggcaatgaaaaaggcattgagaagtgcaaatatatcaacaggtgaaattgatgttattagtgctcatgcaacaagtacacaggtaggtgatcgttcagaagttctagctattaagaaattgtttggtgaacattcccgcaaaattccaacaactgcaaacaaatccatgactggtcacatgcttggtgctgctggcggagtagaagcaattgctttagtggaaagtttgagacgaggaattattccgccaactattaatgtagagaagcaagatccagattgcaacttagatgttgtatcagaagcaagacaccttccattgaaatatgggctatcaaattcttttggttttggaggacataattcagcaatcttgttaaagcattacgattgaagacccatctttatagttcaaaggtgaaataatgaatctatcaagggtttatagcccttgattttcattatggaatacctcacagacaaatgatgacgggcctcagctatctggtatattaaatagaggaaagagaatacttaaaaaaacatttagaaagaaggtgatcccatgccaaataaaagtaaccccaatagattaatcaatgagaaatcaccatacttactccaacatgcccaaaaccccgtagactggtatccctggggaaaagaagccttcgaaaaagcaaaacgtgaaaacaagccggttcttgtcagcatcggctattcaacctgtcattggtgtcaagttcgtatagctacacattatttaaaaaaggacacatataaatatgcatccttacctttttattaacagcaagagttcgttgtactatcacttggtggtgttacacaacaagaggaggaatcttgtttttgattctcgctgttcgatttggtatagaaaaattcccattcattcctatttgggtcagtaatccaaaatttatcttggactgcataacaacaagttgtatccatttcttcacgtgcaaaaacccctctttttcaagcctttccttgtgtttcaaaacttcttccaaactatctacttggaatccaaaatgattcacttgatttcccgtcacctcgtctacgacatttaaagtgaagttcaatccaggagtctctaatagaaacttagcatagtctgtttttactttcacagcctttactccaaatactttttcataaaaatcgatcgatttctccaaactgacaacgttaacccctacatgaacatatttcattttaattccccctctaatatattaatcaaaaaaatttgatttaatgactaaaaattttttagcaacaatctccttcacctttttttctaaatacacaacaaagctcttctgataataaactatttacttcctcatcatttaaatcataatagctccatgttccctttgtctctttcgttattaagttggcatctaataaaattttaagatgataagaaagtttagattgtgttacctcaaaaatctcagtcagatcacaaacacaggtttttcccctttgacaaagttcatacatgatctctaatcgtttctgatcagcaagagccttaaatttttgttcatatttccgaagtagttctgatttcgtctcatccattcatatcgccttctttaatcaattttttttgattaattatgaaacccactaaaagctagtgtaaccagatagaggttttctatttttaatattttcctccatcgctactacaacaaggttacaacttgcttttggtggcaagtcatgaacacctaaaggagaggagatttaattaatctaaagcaaaaaatacaccaatatgatttggtatcttcatctaaatcgagtccctcaacatagtaaatcttcatctacaaaatactttcattacttaacatatatttaagttccttaatacgcaaaaaagttattgcggtctcaccgaaaatttaaattgcggtgccctattgcctttttctgcgaaagaaaacttgttaatatttacattactagtagagttaagggaagggtgaatatcttgatatcaatcacatcagctgaagtgggaatgaagattaatgaatggcataggcatattcaaaaattcaatgttacggatgctgaaatgttaaaggctgaaatagaacgtgatatagaggttatggaagaagatcaagacttgcttatttattatcaactaatggcctttcgacataaaatcatgctggagtatactctgccatctgatgaaaatcgaattgaactttcagaatatttaaagaaaatcgaagggcataagaagaagctagacaatatgcgagcgtattattataacttcttccgcgggatgtatgagtttagaaacggtgaatacacaaaggccattacatattacaaaaaagctgaacgcaaaattccaacgatctccgacaagattgaaaaagctgagttttattttaagttatccgaagtctattatcatatgaaaatgactcacatctcaatgcactacgctgaactttcatacaacatctataaaaaacatgaactttattctgttcggcgtattcagtgccattttgttattgctggcaactacgatgaccttgaaaatcatgaaaaagctctcccccaccttcaagaagctttaaaaggtgccgagctgcttaaaagtaaaaatactcacatctacgccacagcatttttcaatctcggtaactgctatcacaaaatggacaacttaaataaagctgcacgttatatcgagcaggccttggttcaatacagaaaaataaactctgacgtacttccgcaagcttatcacgacctagcgttgatttattttaaacaaggcaaaaaagaacaagcaatggattgcttccgcaaaggaatcagaagtgctgtagattttaaagacgaactttttatgaacttatttgaagcattagacgttctttatataagaaatggcgatacacctaaactcctcaacattttttctcgtttagagaacggcaaaggatacccttatctggaagagctggcattgttaggaggcaaccttttcgattataatggaaaaatagaggatagtatcatctgtttcaagaagatggtatatgctcaaaagcaaatatcgaaaggggaatgcatgtatgaaatctaaattgtttatcagtttatccgccgttttaattggacttgcctttttcggatctatgtctaatggcgaaatgaaggaagcatcccggaatgtaactctagcacctactcatgaattccttgtttgattcgataaacaacattagttctgattccctttagccgtttcataacggctttttcttattttagacatgaaaagcatttcacaaaagctggtcaaacccaaaaactagaactagatcaaaagacacagatcgaatgattcatttccaccctttgatccacataatacttagtttcatcattcttccatggtaatattttgttatataattaaatgagagggtatgaatatgaaagtctttgaagctaaaacacttatgtctgaagctacagaccgcgccaaagaatataaagaactaaggacgcaaatggtcaacttgagaaaagctttacaaagcgtcgctgaactggacgacagcgagttctcaggtaaaggcgctaataacattaaagcattctatcacgatcatgttggtgtcactgatcaatggatcgactacattgacatgaaaatcgcattctttaacagcattgccggagctgtcgaggacaagggcctctctgatgcttatattgaagagtcttttttagaacatgaactggctaacgcccataaaaaatcaaaatccatcatgtctgaacagaaaaaagccatgaaagatatcctaaacgatattgacgacatccttccgctcgacctattttcaacagaaaccttcaaggatgagcttgcagatgccaatgacaaacgcaaaaaaacaattgaaaaactaggtgatcttgacgaagatttactgacagaatatgctatgtcagaaccaaatgaacaattcatcaagtcagacttccaaaagctccaagaagcaacgggcaaaggcaaaaacgctactcccattcactacaacgccaaggcgtaccgtgagagtgatatacataagaaaaaaggcgatattgagaagcgaacggaagcttatttgacgattaagaaagaggaagcgaaggaacgcgagataaaagacttaaagaaaaagcttgcgaatggtgtctcagatccggatgagtatttagaaattgcgaagaagatcgggtatgagaaccttgaacctgcacagttacagtatgtggtgcagctagaacaagcaaaacagctgaagtccgtcggtgaaagtgtaatcaatgcgggtaaaacggcattggatatcatcgatggggttaatgatgggcttaacgatgcgattgatgatacgatatatggcatcaaggacttggttgtaggcgcatgggaattttcacagctccctatggaactaaaacttgcaaaaacaatcacaacagtcttaagtgtcccctcctaccctaaaataatttggacaaacatcgtcgattcatggaatgataaaatgataaatggcaatgcatatacaagagcacattatatcagttatgcggtcggtaatatcgttggtccaaaaggtgcaggtgctgcagtgcaaaccactactaagctctcaaaagtgggtaaagtggttgaaggtggaacagctactgctcatgtcaataaagggataaaccaaggcaaagcttacattaattctattgttagaaataagaatgatcttgcacttgtcgggattgcccaagacatcgataatacgtataatgcaaagaatacgcctttattaaaaaggattattgaagataaaaaagagagtgtacttagaaaatccgagacgtctaacaacatgggtataggtaatgtcaaacaaggtgatagtacccctctcgcacctggtggaggattagctgctcatgaggcaaaaggcgggcatcttatagaaagacatgttgggaagaccgacgaagaactaattcaaagacttgataagagcaaaatgagtaacaagaagatatccggttcatcatcatttaaagatagagcaactgcagaaagagttgctaatagtgctctcacaaataataaagcgaaaatagaaaaatggttaaatagtgatgtgaaaaagcctttagtactctcttataaagggaatgaagttttaggaagaggaataccaaagggagaagatacaattactgatttaactaatgctaaaattatattgaaaaagaacaaagatggtagctttatattaactggctacccaacgaggtgataccatgatagatacaaacatttccgaacctgtttttcaatttctaggaggtatttttcatcaagatatagaaactccagaatcagcactggacgaatacttagaagagattccaaaagaagagcaagaaactgatatagtagcattaaaagattttattaacagtgattatacggatgaagaaaagaatgattttatcgatgaagctgctgacggagtagacattcgtagttacggagtatctccattagtatggctcgaacaagttattcaaaaaatagaaaagaacattgaaactttataatccataaaaggtcccttgaaaattcaagggaccttttattacttcaaaagccctttaatttttgctttcgttttcggtccataaatgccatcaggatttagtccattcatcagctggaaccgtcttacggcatctgctgtttttgggccatacacaccgtcaattccattattcttagctcctttatccgggtagaagtatagtgcagccagtgctttttgaatttgccttacgtcgtctccttttctcatcgggcttgtcactttatagatgccggaaggcagcgcatatgacgttttcttgctgcttaattttgttgttttctttttagctgtacatgttttacttgtgcttgttttcccacctagcgcttttaattctttttcaatggcaaccttaacttgattccatcttccctctgacaaaatacggtgcgggcaatacttaccgttccagtcttggtgcttacggacacgatcaatgccccatccgcgttctttaagtagctgcgccacaaacttaatagcaagattttccgctgccttatatcgcgcccctcctgacttgctataacaaatttcgacaccaatcgacttacgattgcctgtaccgtttgttccatctcctgtgtgccaagcgttacgattcgttggaattccttgaatgacttgtttatcgtctactgcaaagtgaaaactcgttgagctagagttattcttcatgtaagaaatctcattggctgctgaagcatcattcgcagtgttatggatagtgatatactcagctttcattgggttaggacatttcaatccatattttgatttagaaactaaattctttacaactttgatggccatatatcctctctccttctgtctgtgtaataaaaaaagccactggcttagccagcagctctgtcagcgttattcttactctgttctttttcgttctccattgtttgtaatcgatctgttattgttgatgggattttaacaccgatctgtgctaagttttcagttattgacaatccttcattagcgacagcttcctgacgcacgtaggtaaaatatccctatgtgtgtcgtacacctctctgataacaagtgcagttcgtttttcttgaagcaatttcagtacaattttgagtgccacatgatagcttttggatgatccataaccacccacaagaaactgaaacttttgattccaatcaaagagaaattctttaaaatgtgggtttacttgtttaatcatttgtcatcactcttgtttacaatggtgatctcaaaaggtttatcttcttctgtaagttcttcagtctctaatttcttcttgtctatacttaaacgcatatgctctaatttaaggcgtcgttcgtcttccgagtgggctaattcatcaaactgtttaataaagttcctgagctctgccattgccctagattgagcgttcaagaacgttgcatgaggatcccaagaaaattggaattcatactcttcctcttcgccttcgttcacctcagataggatagtctttttctttttcagttccttaatcatttcctgcttatcagaaacgaacatgattttttgcgctcttataattgcggcatattgaatctgaatttggtcccatatcatatcaacaggggatcgctcctgtattccttccatgatcgatagcgtttcttctggcaggaacttagagaagaatccatgagtcacagcgttttgatttctcagtggagctgcaccacctttatttcctaatgcatttttatttccaagcggtgctcttcctcccttatttccttttgcatttttgttccctttaggtgcgcctcgacgcaaaagagcgctccctttcgatttaggagcgctcccttttattttttcttcccatttatcgtttgctttccattttcggacagtgctacttgttacgtttaattgctcagcaatgtcttttaacttcttactcccgccgctctcttcccacaaacgaaaagctttgtctctgcgtggatctcgtggtcttggcattacatcttacccacctccggatctcatgtttgagtttgtgtttgttttaatagtttttttctgatgtgtctactactgcacctttagacaaaatattcattttttcttatttagacttaaatctatgtcgaaaattattgtttgacatatcttatactaactccactaaaagaggtgataacatgtcaaatggttacaatagctccttcgtgttagttgtggtgttgttcatcctgttaatcattgtgggtgcttcattcctttattagtcttgaaatattttaatctactattaaaggaggtaactatatgggatactcgaatggttatggtagcactttcgcattaatcgtagtgctattcatcctgttaatcattgttggtgctacattcctttattagtctttaggcactttaatccaaagcggccttttggatttcacctccctgtacgaagacgccataagaagtttttatggcgttttgctatgttattaacaacacctttaaattgtcaaaataggatagacaataaaagagaggccactttaaaacctctctttttaattaattgttttcggaaatccttaacaacaaggttttccgcagtacttatgatgctcagtgacaggatcgtaacttgagtaactatgcggaaagtaatgaacatgctcataatgttgatgattcacgctagttgtatgctgcggatgaatgtgaggaacaattgtatttgagaacgtatgatgttcacaacacttagtcggatgcaaaattggaggtaaaattttgcaatgatgcatattttcttctcccttcattattttttatctgttataaactatgttcagaagcatctaatagtactattacaaccacctatttactgctccatgaggatttatcaaacaaaatcatgcacatcacaacaaaagctgtatagattacttattagagcaactctccactccacataaataccccatcgctctgccccacgtttctccaactctttatgatcaacgtggggttttattatgaaaagcgctcctcaatatgaatagaacccatttttcttggaaataatcctcctacgaacgaatgcacccgttattagtgaattcgctctaaaagcctcgtttgatagagcccattcaacccttatcatcatcaaacatgaggctttattttgtttttgtcgggaatattaatttttacgcaatactgctggtgttttatcacccgaattcactgtataaaacctcccagttgagttgatcctcgcttatcgctggggggttttctcattccatgaatgtagtggtgacgcaggaataattcgccgcgccgacctgcctcccattttacactacagattttttcggattcaacaagcgctcaaagtggcaatcttggcataattggctgatcaactcgtctttcattttgcgtacagtttcccttgaaatgccaagatgaagacctattgcacgataactcatcccctccatcatgcaatcataaataactttgtgctgctcccctttgatcttttctgcccccaactcaactgcatatactcgttcctcatagtacttaagacgtttgaaaagacgttcctctctcatatccatttgctgcaattctgcctgactcttcccgggacttccttttggcatagctgcttctaatccatattgtgcaacgccccaatttttcattgggattactgaaccatagagcactctctgcaatcgatgaacctcttttgccatccagtgatagctattgattagattttcaatatcttttcgattcatgattgtgttctccttttccaaataaaaaacggacaccaaacaaacagtgtaatactgtaagtttagtgtccgcaggctttccgtcttggacttaagtattgtttttttctattttaatctcgataggtttatcatataaatcttctttcttcttgatcatagttttactgcataaattgtggttactttcatttcctaataaaagatattctctatttatcgaatgtaatatataccatgtttcttttccatcttttatgtaaactttcgtagttttattaaaattaaatattggttttaaaagggctggaatatagcaagaaaaatatacagagataaaaaatgcaacaattttttgagtatttgtctcaaattgaaaagacaaaattaaaccattgagtccagtataaaaatacaaaaggattattaaatatattattgcaataaagatttttagaggtttacccttaatcttttctatgaagatgtaaagtaataaaaatatggacactaacattataccagctatacttatccaccttataatctcaagccaattaaagttgggattataacttgaaataagctgagctattgagacaaaaccgagcgtccagatcaaaacagaaatacaatatatccccaaccttataattaataattgttccttggagtaaaactttttttcaacaatacttgaagaaaacatagtgactggattccccgctcttataagttgtactattaaaaatccaactgcacttattgcaccaggaaaccctaaagaggctaataattgtttaaaagtatcttcgattttaatcaccactcttaaatttcatagttattccattttaccaatttacgctctccttctcaacgcctattattagacgtatcgggtagtaaaaagttgattaatcacctggttttaaattcaaggggataacaactgttggttaattttattatgctacacaaaaaaataattgatcaaatgctttttacctcaccttaaatcctatctcatgatcaactcttgcaaagctcccctttacagtttgaataacagtcttaccgtgctcaggagcatctaagacatgagcagttccctgattcccatctaaaacaatgatctgaacttttcctgggtcaattttctgctgaatagtgaagtcttttttgacgttaatttctcttggattgtacactcaaagcgccccctatgttatgatagaagtaccagttcatatcaagaacactgaggctaagcgcttcggtgttttttatttttaggcagaaacctcttttatcatgatttccaccctcggctcttcgctataaaacttactgactttcaaatccaccacctgattatcatctttgtatatcaactgattcaaagcactttcacaccctttacatagttatcaacatcaggctttgtagtaggccgcaaaagaccattttcagctttctctttctttttttttgagtttgaaactgacttaggcattggtctgtacactttgaaacaggaccagtaataattgtttctggtcgatgctgagacgcaaccaaagctacatactgcttaaaatactttgatttcgctggatttcgcatatgcaccttcccatttctcgtattgatccacgcggctgtccttgtgcgactggctcaccataaacagtgaacttaatgcaatacaactgttctttacctcccgtcaagctgttcccatagctcaatttctttttctattctcggtgcggagagtaaaattgccaacagagacacgactgctttaagcactcagcatccgctccatttgctttattttttcctcaagtaaacggattgttggtgtaagatctttaccttcagttggatttgaaggtccaaatatataaagtccaccaattactttcacattcgtttcctccttcattcccaatcaccttacctatgatttaattgcattcgatcgcctttaataatcactatgtaatcacgacacatctggtgaattcgtgaaccaagagcctcgtctatatccaaaatctcatcgactgttaactcagaagaaatcagcaaaggcttatgattcaaataacgataatttaagactgactggatttgttcaacctgccaatcggttgcccttggctgactgtttattggtttgaataagtcatcaatgaataggacttcgacctttctcatgacatcgagttttacaactaagttgtcaagttatgccagcaatacttatgataatcttctggaatcatggtacttgcaaggaaagaaaaaatgggctcttaaatccgtttaaatctaaacacaaaagaaccgcaactggcggttcttttagtatatattcctatttgacttcattattattggacagtaccataatcaaaatcaatatctttcttgtctaaatccccctcaaaatttttagcataagtcattgttaaatgtacgcttttatctatccaccaagttccatcatcagtattagtatcccaagtaacatctatatctcttcccaaattctcaaaaaacaccaaatttccaacagctactgtttttccgttgattttgtaatatattagaacaattttcttatcaaatatacctgtcccgtgctttacgattgttaaactataaggcttattaggacattgctcttcaagtataacttcaggatttaaaaataaaacataacaaatgaatagaattggtacaatcgttaacctttttaatacttttttattgatatttaacctcttcaacatagtcctccctttttaacaatccatttcatttgggatacaccctcatcattgaaggtatttcctatgaaaaatgattttgaagctcataggaacccttacatgacagggtttttgttgttttttcattgtctattaagatctaaatcaaaaaaagctataaaaaataaggaatgatacatattatacatgactaatatgtatcactcctttagtttttgttcaataatcgcccccgatagtgggataagaaatagcaaaagaacttgctatttctcaaatacatccaccaaatgttcaatgttagtttgtttttcatacatactaataataaaagtaaaaccttattaaaactttacaacacaaactgaatcgactatagtctaattagactaaaatattgatgtaaagaagggaaaaattagatgataaagtcttttttaatgttggggcagtcgaatatggccggccgtggatttttgaatgaagtagacccgatctataatgaaaaaataaaaatgttgcgcaatggacagtggcagatgatgacagagccgattaattacgaccgtccggtctccggcgttggcctggcggcatcttttgcagatgcttggtcgaaagctcatcctgatgaagaaattggcttgatcccttgtgccgaaggtggcagttcattgaatgactggcatccggaaggcatcctttttcagcatgctttgtccgaagcccgcttcgccctccggtccagtcaaatttgtggaatcctttggcaccaaggtgagagtgacagttatcgttcgctacatgaaacttattacgagaaattaactcttatcatcgagacactaagaaacgagttggaacttgatgaggtaccgttgattattggagggcttggtgactttcttggaaagaccggttttggacagcacgcgactgaatttcgacaggttaatgaacaattgctgcgttttgctaatgaacaacagaattgttattttgttactgcagcaggtttgactgcgaatcctgatggcattcatttagacgcagcttcacaacgcaaattcggttaccgctatttcgaggctttttcgaaaaagtaccatatcctgaaacccatttcgggagaggagcaatcgctgaaagtgaatggtgactattctaaaacagaacagatttaccttcatagtatggatttggcttcgggtaaaatcacgtacgcggaatttgaggcgcggatggcgaaggtgatgaaaccatgattcccttacttatccttggcttgctaatccaaaaccccggagctcacggctatgaacttttggccttaatggaaaaacgtcattacaaatacattgttaacttcacgaaaggttcattttattacaatctgcagcagcttgaagaaaagtgttttattgaacagattgagcagaaaccctcaaccagcgggcgtgaaatccgtaactacaaagtcacagattcgggaagggcagaattcgaaaaattaatgatcaaatacggcgccaaatcggaatatgtgaacctgcaattttatggggcgttactctttgcagatgaattcgacaaaaataaattactggatctgatccaatcacaaatcgatcagactaaaactcgaatcgagctccttgatgaatacctgtccatcactcaagaaattcccggcacaatcgattactttcgccgtatgaacgaaaattcccgttcacatcacttggttaatttagagtggtttgaaaaattgaaagcagaaatagaatcaactattgcagaataaaaaaatgcaaagttaaaaataagaatattagttacctacatataaaacctgtgtcgtagatatttagtaacatcttttatacaggttttatactccttctttaattaaacaagtaatagggttgtcagcacttgcccccaacaagagcaagtgaatcagctccgtgttcttcttttcaatcgctagccgttagtttaattagaattcaaataatccaagacgcggtgaactctttcgctgactgagcaatcgccttcaatttttaacactggacaagataaatctgccatccaatgatcatgcaaagctctacttctgacttccattccagcagtatcatataaagaagcccactctaaaaatgcttttgattgttcatatttactgccaccggctaacacttcatttccataacgctgaaattccctatgccttaatctctcaagccgtatatcttgtggaatccataagaagacgacaaggtcaaaataactttttagattatcgccccagccacacactgcaccagaaagaatccatttctcatttattgttaagtctttttcaagcaactttcgtctttcaggaatttctctttttttagtgaatttatctaaccaatagtaatcatcggtatcaagatgcgtatgaggcaaatgctttgataatgcagcacccaatgttgacgttccgaccccagaggctcccaatatgtgaatattttttttcatacttccccctccttattaagcaaccaaactccctgttgcataaggtacttactattattttgacataaatccctaaagacctttacttttctagagaaatccagatgcgtgttaaaatcatcatacttacgaaaacagtcattattaaacggattcatattccatctcctcagatgcattttcctatgaaaaaagtcttgatttccctataatatttaaacgaatccaatttttagattgtcgtctttaaggaggtttttcatcttgaggtatacaaacagtcatttagaggattggattgaaaacttatacagaaagattgatattacagagcctgaacaaattaattttgaacggattgccgaggctttagatattaggctgtcgtttaaacctgttacaagcttcgcacttaaacacagcggaatttataatatatgcttggacagccgtaaaagccgaactgaacaatggtatgattttgctcatgaattttgccatatatatagacatgaaggcgataaaaaaacaatgcctgcaacctggactgattatttagagtggcagtccaattattttacatatcacttttgcattccaactttcatgttgcgtaatattaatctttcgtacatacaatcccatgcaattgaaaatgtagcttggttatttaaggtgtccccttcattcgctaagaaacgtttaagcatttattacaggaagctgactcaacatttatttaatcaaacagttacgggaaatctgtgcaccccccttttgtaattaataatgaaatcctcatgcatttgcgcgcattgaaaaaaacaaaaaaagacgtctcccttcacgatccgatcgggcaggataaggaagggaatgaaataagcctgattgacgttttgaaatcagaaaacgaagacgtgatagatacgatccagctcaatatggagcttgaaaaagtgaaacaatacattgacattttagatgaccgtgagaaagaagtgattgtcgggcggtttggacttgatttgaagaaggaaaaaacgcagcgagagattgccaaagaactcggtatctcacgcagctatgtatcgcggattgaaaaacgggcgctgatgaagatgtttcatgagttttatcgggcagagaaggaaaagcggaagaaggcgaaggggaaataatgcagaagaagccggatctcatactccggctttctctatttcattaaagtttttttaaaaagaaaatagagaaaaaatatataaaagagtgatgaaaatcagttttgtcatcactgataaactcttcgagaaaagcgtctggatcatagcagatggcttctctcttatggggcgttacttccctccatcaagcgattctaagccggacgttctaaaagctctcctgagaaaatccttagatcggtatacttcagtacattcctagtcactgctttctttatagaggcctcatctatgctgtcgatacccttacatatatgactatcacaatgagaggacttttaatgaatatgaagaatcagttaaaaaacattggttagaagcagttcattttaaagaactactcattttatttcttcttcaattaaatcactggcgtttaagtacaattcttcacaatctcttctgttgactccaatccctaagtagtgctcctccagtacggtgacacatatagagggacgagaaaatctcatttaaactgcccatccgatggcgggcagtttaattattacctctcctgttcctttatcaccctctcaatcccatataaaatcagtttcaagccaaactcaaatgctctgtcagtccccatcaactcaaacagcccgttcgtaaacatcctccggaataatcccgcatctgtctcgctcatggaatcaagaaggcgtatcatctcctcccccggatgctcttcttggtccttcaggatagcagtgacattgcgctcatgctgataatcgtctaaaacgaagtagaagacatagtttacaagcgtagtaaccacttgcattttctgctcttgcttaagtggtgttgattccacgcagagtaacattcggttcgtgaatcggatgatgtccggttcatggggcagcgtcatcatcatgagctgcgtagagcaaggatatcggctgagcacgttccgtaccgttatcgcaagccccatcagctgctccttccagtctccctcggagtggaactcctccagaatcattttcgatacttggttagccagacgctggtaaagcttctgtttgctcttgaaataccagtacagagagggagcctgaatccctagcctgttggccaatcgtctcatgctgaatgtttcgatgcctccctccccaagaagttcccacgaggtttctaaaatcttttcctctgaaatctgaggctgctgctttttcatattatccgtccttttatctaacagtgtaagtttctctttacaggtttataaaatgatgataccatctaacactgtaagactcaaactaacagtgttagattaaatataaacaagaaagaagtgaaatataatggatacagaaaacctctattattttgaaaaagcaccgatcgcaaaagctgttgctcacttcgctataccgatgatgctaggtacatcaatgagtgtcatatattccattctaaatgcctttttccttggtacactccacaataccgccatattaaccgcactcgcattaaccttgccgttatttgcaatcattatggcgctaggcaacttgattggcatgggcagcggtacattcatctcccgtttgctcggggagaaaaaatatgatgatgtaaagcatgtatcctcatttgccttttacagcagtttagttcttggtcttattgtgatggcagtgggtctccctttaatcgatccaattgttcatggcctgggggcaacatctgactccttcggcttcacgaaggactatgtcatggttatgcttattggttcacctttcgtcgtattatttttcacgctggagaatatcgtgcgctcagagggttcagcaatcacgtcgatgaccggtatgattctcagtgttgttgtaaatattatgcttgatgcgttagtcatcttcgtatgccattggggtgtaatcggagttgcgtctgctaccgtcatttccaacttggctgcgagttcattctatgccttccacatgggatataagagccagttcttaactgtctccgtaaagtggttcaaggttggcctggatattctgagcaatgtattaaaaatcggcattccggtctttattatgagtatttttttgggggcaatgtctcttatctttaatcattttcttgtcgaatatggggacaaagccgttgctgcatacggaatttcatcccgcttatttcaatttcctgaatttattttgatgggactatgtgaaggggtcgtaccgttaattgcattctcttttacagcggataaattacgcatgaaaaataccattggatttacattaaaagcgattgtgacgctagcagtaatgtttggcgttatcgtctatttaatttccgaccatctaataggtttatttacaaatgacccgcaattaattaaaataggcagctacattctacatgttacgtttttatccatatttattacagggatgtcctcattatttactggtatcttccaagctaccgcgcaaggaacggccgcttttgttatgtcatttatacaaggaattactctgattcctgtattgttcatcgccaatcaggtgaacggctttcatggggtggtttggtcacttgtcattgcagatacagtcgcattccttgtaggtgccatcatgctttatgctttgaggaacaaattgcagcctgaattgaatagttaagtgctagtaaacatatgacatttaaatccgtattgtaaactaatcaaatatgtaaaaaaagatagtttagccctcataatcggctaaactatccccttctcaaatcctcccactttattattaatgtggtttagaagaattgaacctgcacgagttattccgctcactatcattgattatgaagcttatatattaaaaaatggtgagctcaaaacagtaaacgtcgggcttttttactctcttccttttaaatacacgattagaatcatcaaaaacaataatgatatttacacaaattgcgatttacgcaaaagtcaccactcctcttttcatggacagaaaaagaggagcaaacctatgtctgcgtcttaacgtttttctttgcacaacgtctagtatcttctttggatcaatttttctgtaagaaattcaacaagtgttactcaacgacatgaagaaattgtttatgtccttgtcatttcagttattcaactattggtgtaagtgaactaccagcccatacctctcccttattaagggtccagctgtcattataaaaattagacccacctttattaaccgaagggctgtgaacctcatcccaagttagaaagtacacggttttcggatatttttgtttgactgtattaagaaacacagcataatccaaattaccatcttgtttttgtgtgccgatttctgtgaacgcaaatggcttattaagagctgttaactcatcatatccttgaattgtaaaatcatctgagaaatacgcatctaatccaacaatatcaacatatgaagatccaggataaaagtcagtcttaaagtctcgattggcgtccggtgagtaaacccatatcaggttgtccaaacctcttgtatcagtcatataatgatagattttttgataaagttgtttataaagtgagaagcgctggctgtcttttttgttatattcggttagtccccaccaaaaccattctccattcatttcatgaagaggtctgaatagaacaggtacaccttcattttttaactgatcaaggccatctgcaactttgctcagaacagcctctaatcgcttaccctctgtagttgatgagtctaagattttttcatactcactgtttgaaatatgggaagcatttttcccaaaagtactggatgcaggattagctagatgtaagctaatctgtggtattccaccacttttccaatatgagattaagtcactgttgcaactatagtcgatcgtctcagtaatatcagaaatatagggcttctccaaccatccactggaatagtcacaaccataaattgcgggtaactggcctgtagcattcttaattcggttggcttctttcatggaaaacgaagcatttgtgaatccgccgaatgtacctgacagtatgcgattttcagatcggtttggcagatgagccagccaattcatcaactctttcgttgttgcctgtgcattaggattcacagggtaaactgtatgagcaagagccgactgtgaaaaagatgaaaggattatgaaagatagtaatataaaaacagcaatttttttatacataatattctccgtcttctactttttattattttaatcatttattctgttaaagatttataaagcacagaatctattaagtcatttacgctttttcatcccctttcatatttaaaataagagagaccttccttagagatatttgcatttacccattgtaaatctccattttttgggcattaattatattaaaccgaaaaatatcttctttcatcagacgtttcacctattttttactgtatgcctcacagactataaagcaaactttcccttttgcatttaaaccttattacctatttcattaagtcgaattattttcgatattaagtggtgaatgattttcactctcttttttatcctattaaattattttaaaaaataatcaaaaaacaaatcattttgatccctattcatagcagcaaacgttacttttggtacaaagtcctttataaacagaaagaggagcaaacgtatggtttactcctctaacttagtttctttcttcttggtttttcataatctgatgttttccttaacagcagttccaacccgtcactttctccgcagcatataatcaagattctaataccaatccaaaagttattttgatctactgagaattttaatttgcggtgccctattgcctttttctctctctgactcatagttttaaaccattcaataaaaaaccctcaattgatgtttcatattcatttgattttcaaaaacttcagccgtatcaacctgttaatcttacccgctgacttatatcaaaggagctctaaccaaattttaatggctgtcgaacttattaatagcgctaaaatccattgcaggaattttgtatttactttttgcccaactgatgcgccaataggagaagcaattaaactagcaatcataagaaccagggctggtacaaaaagaacctggcccgtaattacttttccaactgttgcgccaatagatgaaagaaatgtaatcgcaagagatgaagcgactgtgattctaacaggaatatttaaaatcgataacataatggggactaggataaaggcgccgccagctcctaaaatacctgatacgccaccaatgataaacgctagggacgaagccaaccatttattaaatatcacttcttcgccttctctatgggcttgtcctcttttaggtataaacattaaaataactgctataatagccagaattccgtatataaagttaattcctttttcagatatataatgagaaaagtaactccccaatacactccctaaaaggatgctgcttcccatgtaaattattaatgctttatttagaagaccactcttacgataagcccaaacaccgccaagtgtcgcaaagaaaacttgaatagcccctatccctgaaacttcatgggcagttaatgacatcactctcactaaagagggaatatacaacagcattggataattaataactgctccgccaataccaatcattccggaaataaaggcaccaataaaccctataatgaaaagagttgtgataaaggcaatatccactttggtttcctcctatcaaaggaaaagggtatctttctattcgataccctttcacattcattagcctttttgaatccaaaatttcaatacatcgccctcgtccgtttgctctaaaaggtcatgtccgcctgatttagaccaggctgcaagatcatttttagctcccttatctgttgcatgcacttctaatatttgacctgattccagttcattcatcgctttttttgtcctgacgattggcattgggcatgccaggccttttgcgtctaatactttatctgatttcatgttcatctctcctcttattaatagaaacttgtgttaccgtattgcacagcggtttgggccaatctccatttcacgctgtttttcttcatctgggctgattttccccatgtttgtttctcgaatctcttggtatgcatttggttgcggaggcaaatgatctgttactaggtgtctaaattctgtttcatccgcaatgttcaaaccatggttctcgctaaataatgtacttagttttttaccaacacttccatcctcatttagctcgtcaatgatcataaagtgtgccggtaatacaattaaatcctttgataacgctttgtaacggctataaagcgtttttcttaaatctcctacccaatcttctgccataccggctaagtctggtctgccgattgaatcaataaacaaaatatcacctgaaagaagatacagatcatcgacaatgaaagaagtggacccaatcgtgtgtcccggagaataaatcggttgaattttaatcgttgtatttccaatgatcatgtcgtttccttcttccaacggctgataatcgaataccacttcttcagcatctttaggcggtaaccagtaggttgcttttgttttttcagcaatgactctgccgcctgaaatatggtccgcgtgaagatgtgtatcaaatacgtgagtaatcgttgcacccttctccttcgcaaaatccataaagaaatctaccatacgtgtcgcatcaataattgctgcttcaccattggaaatgaccatgtatgacaggcagcctttaccgattcgaacaaactgatacatctcaccgccatcttttaaatccccgacttttaccggctctaaatgttcgctccatgctttcattccacccttaagataggatacagaatgacctgcttcagatagcatttcggataccatgacggatgaaccttcttttgcacaaacgaccagcacttctttatcagaaggaattttctccaatatatcttctacgccatctaaaagatcaaaataaggaacattcaaatggtcaaagtcatgcccttctatcttccaatcattaaaatcattttcattacgcacatccaaaataaataaaggttctttgttatagattttttttgtcacttcttttggggtcattgcctttacggtcatgtttcaatacctcctatatcaaatcttttagcggaactaaaacgttaaggatacatcagcatctttaacaaaattctaaaaaggtaacagccccgcctacttcgattccttgtataaattcatcttttgttaaacccataacgtccatcgttatttgacaaccaattcatgcaactcccatttcaatcagttaagaatagaaggcacatttgcgttcctacaaccttctgcgacatgctcttttccttgtcgcaatattacagactttataagcatcaaacagaccgccatttgccgcaataatcgctactcttgtactcatctgttcatcatgctttttatttattcggttttacctgtccactcccgcataccggggacaacattaataacttttttaaaaccttgttttttcatggtgtgggccgccatttcacttcttcttcccgaatggcagataatataaatttcatcatttttgtttaattcattagagcgcttttccacttcaccaagagggatatgcacaactccaggaatatgagctttttcatactcctctatctctcgtacatctaaaatgttaagagactcgtcactatccactttctgtttgaaagcttctaatgaaatatcaggaattgaagatgcattttctgatgaatgctctcctccttttcgaagaaaatgacgaagtatttctccctctgcttcagtacctagatattcatggcctgtactttttgcccatgcttccagatctgctgtggaacctttatctgttgcttgaatttccaatacttcaccagcttttaaatccttcattctcttcttcgtttttacgataggcattggacacgccaaacctttagcgtctagtacaatagttgctttcatcattttttcctccttttttcatataggggtgggggtatataaatatacaaaaagtttctcactagaagttaataccatgtattcatgcccccttttatatttgtgatgtttttaaatccttgtttcttcaatatttttacttgcctttaaacttctcattccgcttagcaatgagtaaatgagtagcattagataaataagttgacactgccttcctcagcatctgccaaataagctgctacaccagcatagtcgatatcatctaatagttctttttcctgtaaaccaagaagatccattgtcatcgtacaagctacgagctttaccccctgttcttgagccatctcaatcaactgaggtaatgtaagtgcattatgctttttcatcacatttttaatcattttagggcccatacctgcaaagttcattttagataaacccatcttatcagcaccacgaggcatcatctttccaaacattttttcaagaaatccttttttcactggaatcagctcttctttacgtaaagcgtttaatccccaaaaagtatggaagatcgtcacttcatgatcgtaggcagctgcaccatttgcaataatataggctgccattgccttatcataatccccgctaaataaaacaattgttgtgcgttttgtttgttctgtcatgtttattcccccaactaattacccctgtgggtatattaaagtcaaaaaaattttttcgaaagatctgcttttattcaactctttaaataccatagggggtataatataacgcatataaaaattcgtcaaccttaggttgatgaatttttatcggctctttaccaataagtcaactgcttcttttactaaattttgtgtgtcttcgcctttttctaaactttcacgaacacaatgttcaaggtttgtgctcacaattaaacccatcgctcgatcgatcgcattacgggaagctgctaattgggtcacaacctctctacaatcttttccttgttccatcatagtcaatacacctttaatttgtccttcaatccgtcgtaagcggtttttaatcttttgatcatactccatatatcaatgaaatcctttctttcatttatttttacatttacatgctgccagttcataactgtttacatggatacctttgcgctttagaaaacgcactcctaaatttaattccacccgatcacgagctattatgtgtattttatcacgtggaatctctaaataaaaacgttttagatacgcatatgggatgtttaaaataatattatccgaaaaattggctacatcgttataatgacgaatatctaatattgtgatgtccatagcctctaatttatctttatggatacaagagattccggttataggataataccgtctatacgatgcaatgataatcacaaaaataagcaggaatgcaataactaaataattgatactacttacaccaccttattaactctttgttattcacaaaactataatatacccccataggtatatagtcaagtgtgaaagttactttctttgagctgatagattcatttcaatatccgcggattgaaaaaatacttacatttcgataatgccaattctgctaaaagtaactcgaataaagaaataagccgattttattttaaatcgactttattttatcaattacttttaaaattagcacaagactgcttggatattacattgggtttcatttgcataaaaacaattcttaggtactggttccccatgtttcatgctggatgtgactccaattactcagaaatctgcgaataactatgctaatcttccgcagccactgcatctgctttggttttatgaactgtaccaaatggatggttaggaggagcataaatggagtaaagttttaatggcgtattacctgtattaatcacgttatgccaagtgccggcaggtacaacaatggcagaatcatcataaacatttctttgaaagttcaaatgatctttgctctttcccattttgacaaccccacgcccctgctcaatccgtaagaactggtcaacgttaggatggatttccaacccaatgtcttctccaataccaagactcatcaaagtaacttgaaaatgctttcctgtccataaagcagtacggaacgtattgttttgttttgtggctctattgatatttacaacaaatggttttggtccataatcctttaaaagaagatttctatcttcatatgaagagcgcaaatcggcacctctgtgtacgttctccatctcatttggaatagtccaataaacagatcttccatcattatacatcggtacagtcacataataataacattgaggcgaaaaagggttatagtacattttttgatccccacaattataaatttttgtgatagtatcctatgcatttattaagggagtgtgctaaatcaagaaaaatcatattaaacacaaaaatgaatgttcgatcaccgtttgattcacggatgaataatttatcaccgaccttgtaatcgttttctggatgttgaatttcactagcctttgttaacaagacatcgaatgacacttttatatcatggattatcaaaggtcgacgatcctaaatggcttttgaacatttacatagcacaacaacagagtatacggaattctgttgtttgtcccccctatcccagctcttttagatttatccctttggatgcgccttgatggccagcttttcagcagcgtagtatttagcgcctcctgaatcgttatagcatatttcaacgccgataaacttgcggttcccagtgccgtttgtaccgtcacctgtatgtgggctcgtttttagtaaaccagtttatattctttttgggcacacaatagaagcaatttttcatatgaaaatttcgtaatcttacacctctttaacttgaaggaggatttttgcatatgtattttcatacccgtcaactaccatctcatccagcatatattcctcatatgcattttcccctatttgcattccattcttttcaatgaactcaatgattctccggtacgcctcttcagtatttccgcctatttcatatccaactgcatacaggccttttggccgtacatgataatttatgttctctcccccattttttacttttatataaaagtaactgtaattgtagaagtctttttctaagatttgttcccgtgcaaagattccgcctatcggatatccttcatctaattcatattgctgaacttcatgaatgagttctgaaatggctgccacatattttcgttccggtaagtttaatgtttttcggcttaacatgaatgtttcttcatttaaatattcaaaagaaattgaggaaaaatcagtctcaagtgcttgttctgtaagcgtcacttttgtttgtaagatcgtttgcaactgcttaagctcatttatttttttatcaatctcaatagacttttcttttagaacatgcaggatcttgtctggtgtttttccttttattagacactttatttcttttaatggaaccccaagctctttaaatagactgatgacttgaaaaatctcaaattgatgataggaataatatctatacccattttctttttttatttccggcgagaaaagaccaatctcatcataatgaaataaggtttgtttttttacacggcagagcttcgaaaactcccctgttgtgaaatacttcttaacatcttcgctcataaaaacctccttgactatacggtaaccatataccttatgatttgattgtacttgaaaaaagcttcaagcgaaaaggataggtaaaaagggttcaattgagtaaaaggggaattcagatgaaaaaatcaataaatgagcaaaaaacgatattcattatactattaagcaacatcttcgtagcatttcttggtatcggtttaatcattccagtaatgccttcttttatgaaaatcatgcatttatccggcagcacaatgggttatcttgttgcggcttttgccatttctcagttaattacttcaccttttgcaggtaggtgggttgaccgtttcgggagaaaaaaaatgattattctcgggttgcttatattcagtttatctgagttgattttcggattagggacccatgtttcaatattttatttctcgaggatattgggtggtgtaagtgcggcttttatcatgcccgcggtaacagcatatgtagctgatattacaaccctaaaggaaaggtcaaaggctatggggtatgtttctgctgcaattagcacaggctttattattgggcctggtgcgggaggatttattgccggctttggcatccgcatgccgtttttcttcgcctccgccatcgcgttaatagcagctgtcacttctgtttttatactaaaagagtcattgtcgatagaagaacgccatcaactctcatctcatacaaaggaatcaaatttcattaaagacttgaagagatccattcatcctgtctatttcattgcatttattatcgtctttgtaatggcttttggtttatcagcttatgaaacggtattcagcttgttttctgatcataaatttggcttcacaccaaaagatattgcagccattattacgattagctccattgttgcggtagttattcaagttttacttttcgggaaattggtcaacaaacttggagagaaaagaatgattcagctgtgcttaataaccggtgcgatcttggctttcgtgtctactgttatgtcaggatttttaactgttttgcttgtaacttgttttatttttctggcgttcgatttgctacgtccggccttaaccgctcatttatccaatatggccggtaaccagcagggtttcgtagcaggcatgaactccacatacaccagcctgggaaatatatttggacctgctctaggcggtatactatttgatcttaacattcattatcctttcctttttgcaggtttcgttatgattgtcggccttggtcttacaatggtttggaaagaaaaaaagaatgatgctgcagctttgaattaattcattttctataaagtcaagtcatttggatgcagggaatgcccctggttaggcacaataagaaaaggtacttaatttgataggctacatgttgcttgacgtgaatatagtttaagctgagttttagcaatatcaggataccgggataagaaaaaaggagaatgtagtatgagtataaaaataaaaggagtaactgatgataatcgtgctgcaattcttgatctacatgtcagccagaatcaattatcatatattgaatctacaaaaatatgtttagaggatgcaaacgaatgtcactattataaacctgtcgggctttactatgaaggagatctagtcggttttgcaatgtatggattgtttcccgagtatgatgaagataataaaaacggacgagtctggcttgaccgattttttattgacgaacgctatcagggaaaaggattagggaagaaaatgcttaaagccctcattcagcaccttgctgagctatataaatgcaaaagaatttatttaagtatatttgaaaataatattcatgctatacgcctttatcaaaggtttggttttcaatttaatggtgaactcgactttaatggtgagaaggtaatggtaaaagagctatagatatccaggcctccttttttgctgagaaacgtttgaacttcgataatgattacctacttaaactgcaagatcattgtttaaaaaagcctggatgaaaatttcatctcaggctttaagcatcttattagtcaaaatctcatgtgttttatccagatgttattcttttttccggacaatttctaaataattaatatgccggccaactgttttgtgcactttaaaaatatacccatcggcttctataacggacccaactgcagcgtctatttgttgagtcataaaccagccgcctattgtatccacttcgtcacttgctaacgtcgttcccaataaatcatttacatcttcaatgagcactttcgaatctaagatatagtgattatcatttacttttctaatattaggcacttcatctttatcaaattcatctctgatttccccgacaatttcttcaagaatatcttcagcagtgactaaacctgaagtgccgccatattcatccacaagaatagcgatatgtgttcgctctttttgcatttttaccaataaatcatgaattggaacggattcaataacatggataacagggttgatatgattttctaacttgaaatcctcttttatcttctggtctgtgtcaatataagctgacaaaaattctttagcattgataaaaccaatgattgaatctttatctccatttaggactgggtaccttgtatagctctctgtcttaatggtcttaacaatagtttcataagaatcctcactagaaatcgctacgatctctcttctcggaatcataatttctttggcgattctttcatcaaattcaaaaatattatttacatatttcaactcattttgattgatttcaccgctcttatagctttcagacagtaagatgcgcagttcttcttcagaatgagcaagttcatgttctgatgcaggtttcaaaccgaagagtcctactataaaccgggctgaaccatttaaaaaccatataaaagggaacaggatgcggtaaaaccaaataattggctttgcagtcaaaagagtgatggtttccgctttttggatagcgagtgttttaggagcaagttctccaactacaacgtgcaaaaaagtcgccatcacaaaagcaatcactaagatcaatacatgtgagactgtttcacttacatgaaaatgagcaaataaggggtgcaaaatcacttcaaaagtcgattctccaacccagccaattcccaacgctgtaaccgtgatccctaattgacaagctgacaaatattcgtccaaatgagtaatgacctttttggctgatacggcacctttttttccctctaatatgagttggtcaatttttgatgacctgatctttactatcgcaaattcagtcgcaacaaaaaatgctgttaagacaattaaaatagtaaagattataaggttaatggttgtcaatgatttgccttacctagtaaggcgtacacctccgatataaatatttatttttataacccgttttttctgaataaacaaaaaacagtatatataacattataagttcaaaagaacctaaaatcaactctgaatgatgtaaataatcatctttttccgtatggagagtggttcccgtagtattcaactagcgattggtgacgttttaaggcttaaaatagaaagcaaaataaaaacacacctgaattttctggtgtgttttaataatatccaaccgtcttgatttatttaatgtctttattaaggttttcttttaaaatttgaatcaattccgcctgttgctttatatttttgcggccatttctattaattgcagcaagttcacagacaattccagctgaaatgaaaaacaataaaccttcaaacattttaaatcccccaccatctaagtgatagtcaaatttgttttttctttttgtaatacctgcttataatcttccttacgctgatatatgttatttaaaatgagtccaataatgacaaacagtgttcctactatatcaaatgcagttatgttatatcctttgatcaccatgattaacaatgtagtaatggggacaaagttaataaataaaatcccattaatggatgataggattttaatgccatagttccaactaaggagggctatgatacctggtaaagtaatcataaataaaaaatcatacttaattgctgcaatcactttaatactcggtaccgacacgtaaccttgcgcggtaagtatagctgtcatgattcctgttatagctgtgccgaataaacatgtcaatgttgaataacgaagtgtggaccactctcggaatatctgtccccccattgtgtagacaacccaccctaaaacaccaatgaatataaagagtagcgagaatagatgatcccccaataaaaaaaagaaacttatattacctttggttatgaccatcgaagcccccaaaaaggcaatcaatatactgatcattgtgtattttttaggtttcacatgtttatatccccatagaataacaattgaaagcattggcatgagtgcctcggcaatggatgctgtcataattccagacttccccatcaacctttgacctaaaaaaataagaacattgtatacagtaaacgccataaccccaaataaaatgatccattttgctttaccctctaaatgaaatgatttttttccttctcttaccaataataaaatcactaacataatcgttaccacaccgtagcgaataaatgaaaaataaaacggatcaataacttctaatgcatgatctgcaactggaaacatcgcgccccaagacatacttgctactaaacatgtaagggcaccaatgaataattgactttttttcattgaattcccctccttttctttaaaattacaatgagaattataaaaagaagtaagcatcaagtaaaatgaacaaaagtgatgaaaaacatcattgataatgatactttaatgaagggggatcttcatggaactgcgagacttacaaattttcaaatgcgtagcccatcacaagagtattaccggtgctgcaaaagagttaaattatgtacaatctaatgtaactgcgcggattaagcaattagagaatgaactcaaaacacctcttttcaatcgtcataaaaaaggggtttcactaagcccagagggccgaaaaatgattgaatacgttaacaaaattttgaaagatgttgaagaactggagcaagtctttctagatactgatataccttctggaatattaaaaatcggtacagtggaaacagtgaggatactgccgaccattatagcttcctattataaaaagtatcctaatgtggatttatcattgcaggctggtctaacagaggaacttattaaaaaggtcatgaatcacgaattagacggagcttttatttcaggccctttgaaacattctatcctggaacagtatgatgtttatactgaaaaacttactcttgtaaccagtaacaaaacgtttaatatagaggatttttcaacgactccgattcttgtttttaatcaggggtgcgggtatcggtctaggcttgaacagtggctcaaagatgaaggtgtgctcccaaacagaatgatggaatttaacatcctggagacaatcttaaatagtgttgcacttggactcggtataacagtggtaccggaatctgctattatgcatcttgctgcacaaggtaaggtttattgtcacccattacctgagaaagacagctgtatctcaacaatctttatacgccataaagatgcgtacctgacaaattcaatgcgcagcctccttaagaccattgttgaacataaaaatatgagtatgtcttaaagtgctttttctctttctatgttaacttcttaaataaaagagaaagcgcatctccacttcgctacccttattcacgcaaaaaatagagcagtaaacatgtgagttactgctctgcttcgtttatccaccgttcatttgttttacaatgtattcagcatcatttcctacaccttgaagcaacgctgaacctcgcttatgctgccaaggcaaccctataaagtacaatccttctacaggtgaaacacctctatgatgtatgattcgaccttctttatccaaaacaccttttatatttatccaacataagggattcctgaaaccagtagcccaaataatattgtttacttctaatgtagatgaatctttaaaaatgatttcattttgctttgcggcaatgactcttttttttaagatgatctccttctgttttattgcatgttttaattcatgcccaaatactggatcacctttcttttgaatgaatttgcctactattgatgtatgacttgcatgtaaaactcctagtttatcaaaccaccaaaagatgcttctttttcctatcattaaagggaaataaacaagtttattactacaagctaaatatgtaactctttctttggataattcaacagctatttgagcaccactattcccaccaccaactactagtacatttccatatgccaattgttttgaattcttatattgtgatgagtgtagttgattaatattatcggataaatcctttgatattgatggaatattaggggtatgaaaaggccctgtagcaatgacaagattcttcgtttgatattcttcccgatttgtttttattaagaaataattctttatttttaggacacttattacttctgtccgtaattggattggaatttcaaattttttaacatacttctttagataagcaacaatttcattttttgaaggaaatccatgtttttctccttcaagatgcattccaggcaaagagctatacattcgagaagtaaataaaactaatgagtcataccgatctttccagctctcccccaccccatgacttttatccaaaataataaacttttgatcggactgctttagataataccctatcgagatccctgcttgaccagccccgattactatagtgtcgtacacattatcaccccgccaatttcaaattgtcagtagacagaatttgcaaaatgctagttgatctcctcactataaagttagataaaaaatttaatggtgatggtggttacgcggcttctccattttaggctgacaaaggatcgcattgtcgtgattatgcgcttcggtttccatttgaatggttacgtgcgtaatgcctttatgctcaagttcatgttcaattttgcgtaaaatattttcactttctgaaatggtcagttgatcgtccacaactgcatggcaagaaagagcattcaatccgcttgtgatagaccatatgtgtaaatcatgaatgttttgaattccctctgtcccttcaattgtacgaatgatatcagagacatcgatattttctggagttccttccattaagatgtgaatggaatctttagtcacattgtaaccgcttcttagaacaagaatagccacaatgatactagccaatggatctgcccagccccatccaaagaagatgataagtatggcagctaaaatggcacctacagagccgagcatatcgcttattacatgtaaataagctcctcttatattcagattattctttgtatctccgccactcatcataatccaagcgaccaatagattcacaactaacccgatgatactaattgtaagcatgccggttgctgctacttttggtggattagagaagcgttcgattgcttcataaatgatataaagagaaataagaattaaggcagcaccgtttatcacagctgcaagaatctcaaatcgtttatagccgaatgtcttattgtgatttgcctttttttcagctaatgtaaaagcaatcagggcaaccattaatgaaattgaatcactcagcatatggcctgcatcagataaaagcgccagactatttgttaaaaatccacctatagcttctattatcatataacctgtaatcatgataaaagagatcaataaaacctttttatttgctccttcattatgattgtgacccataaaaaactcctccttaactaaagtttttaatacatatgtatttattatttcaaatctgttatgaagcattctaacatgatgcaaataatatttatatatgagcatgtgttcatatataaatatatctgctctttactgaaatgtcaaaatattttttatagaaatcaacaatacctccttaattattctcttattaacataaaaaagcggaacaaacacatggtttgctccgctaacctagtttctctatccttttcttgtagtatgcaactacaatttacctgttaaaaattaggcctcaccaagtccaaaactccagtcagcattatcattttcaacaatagatacaattaaatcagttgatgcgataccacactcagattccagtctttcggctaacagcctgtagaatttttgtttcttctcttccggtcgggatttacttgtaacagaaagaacaacaagatttttggttcggttaaatcctaagcctgtatcctcaataatcatatgattttctggatgttcatgcacaatttgataacggtcctgttgaggcacatcaaaagcctctactacaacattgtgagcgacatctaaaagttttttcaaacttgattgatctcgcccttctattaagtcaaaacgaagtaatgacataaaatcccctctttctactgtcagatatttctaatcatctgctacataatgtgctcatttttattcttactacattagaataaaataatttcccaataaccccttcattctgttgttagtcaagcctatgttatgatgtgtatttccataggcaatatacagaatcaacttcgagtaattaaccattttttgaaatagccttatcacttactctagaaatcatttattcttctaagctttagtttacatgaagctctgctatcatatataattcaaaattaagatggaagacatctcaaaatcagatatcaattatggaggactgcatgaatattcagttgttacaggtttttctcactactgctcgtgaaggcagtatttccaaggctgctcagactttaaattatgcacaatcgaatgtaacgaataagatacaacaactagaaaacgatttacagacaaaattattctatcgccatagtcgaggaatcacacttactcccccagggcaaattcttgtttcttactcagagaaaattctacatactattgaagaagctagagcagccatgggcgaatcatccgcgccttctgggccactgcgtataggatcaatggaaacaacagctgcagtttggcttcctcaactccttgcacattataataacctctatccaaatgttgatttgaacctagtaaccggtcctacggaacaacaaatacaagcagttttacattatgagttaaacggcgcttttatttcagggcctattgaacaccctgatttagttcaagaaaaggtattggatgaagagatggttcttgttacaagtgcttcacaccctgtgatttcttccattcaggatgttcaaacacaaacaatgcttgtattccgtaaaggatgctcttacagagcaaagctcaatcatatcctccaagaagaaggtttattacctataaaattaatggaatttggcatacttgaagcgatcattggctgtgtaagcgccggcttggggatttcactgctgcctctttcaatcattgcttcgcatgaaaaagaaggccgcatccgcagccacactatctctgacaaatattctttcgtatcaactatgtttataaggcggaaagacactttaattacccctgctttatctgcttttttaacgcatatgagggatcattttcagataaagaggccagatcaatcgtaaataaatggatggaaggcatgcttcgcctcaaaatacccctgatcagttgtctgatataaaaatataggcgcatctcaatgtttgtatagagcaaaaaagcaaacttcggtatgtagtttgctttttcttcgtgattttgcactcagaatcgtgaaacctagtcgatattaggatgtagattttcctcattcaaagaattttgaacgaaggtcattgccctagacacttggttgcgtcttgaagttaaaggctgactatttcctaaagcgtcaatcgctctcacaactattaaatattcacctacagatttcgggtgacaacgggaagattgatattttcggttggacaggggcagaacatccaattgtaacagttgaagtatccactgatggaggagatcctgcagatctgagtgatattgctgttaattgatcaacttgtttttgttcggaatatactcagtatatagccgcatattcctcctgcaatagctggaatgagccaccccagccctatgttatacatagggagaatctgagagaaaatatgattcacaacttcaatttttattcccgcctccttcaaaccgtcaaataagctgatgatgaatgcgaataataaactgccttgatacacttctgtcttccctttaaatacagaatgcaaaaacgttaaaaatattaaggaaatcgcgataggatacattgtcagtaagacaggcattgacaccttaatgagctgggttaatcctatatttgcgacaagcgtactaaacactgataaaacgacagcaatttttttataagaaatgttcggaaatagttcatgaaaaaatgaagaacacgcagtgatcagtccgacacttgtcgtcagacacgccactgtaatcattaagcccaataagattgaaccataagaaccaaaataataggatgaaaccttagccaaaacctctgctccattttctaaaatccccagttcttcaacgctggaagcccccatataggaaagggctgtatacataactgctaagagtacagctgcaatcgcggctgcttttgcacaaacacccatcagctgttttttggtagaagctccttgttctttcaatgcattcacgatgataattccaaaaacaaatgctacaagggcatccagagtgaggtatccttcctgaaatcctttaaaaaacgcttgtgatgtgtacccttttgatggtgcttgaatggttccaattgggcgaataagagctaccactacaagcaatccgataaatgtcagcttaattggcgtcaaaaatttcccaactatatcaatgatttttgaaggattgagtgataacaagcatgccaatgcgaaaaataatattgtaaataagattaatgagacagggcctgcatcatttgataaaaaaggttttaccccaatttcaaacgatacgtttcctgatcttgggatagcgaaaaaaggcccgattgccaaatagagaatcgtcgtaaatacaatgccaaacaccgggtgaacacggctggctaacgactgtaagttttgtttacccgaaaaaacaaatgctgttatagccagtaacggcaatccaactccggtcactaagaaacctgcattagcgacccatacatttttcccagccatttgaccaagcataggcggaaaaatgaggtttcctgctccaaaaaacaatgcaaatagcattaatcctataatgatgatataggaagcagacactttttttgacattatatatcctccgattaaagtagacacttcttgaatagccaggaaacattacagatgctatttgcactggcgcagtgttgattccaaaataagtttgtgtcagttttatatatttttatcaagttcaacaaaagcatgatcattttgatcgtttccgatatcggttaaaaaaccaattgcaccaaaaccatataaacaacggttccccccgctatggaaagaagcatatttttcttccacaagtgaagcagtacaactgcagctgctccaaccaattcaggaatgccatgactttcagaaagcagactcacatcttttaaacaataaatgaccaaaagcccgattaccgctgatggcagcactttaccaagatattgtacatatttcggtgtcggtttgccagacgggaaaatcatgaatggaaggaaccgtgtcagcattgttccaagcacgaccattgcaatggtgatcatttgctgcgtcatagtcatcgtcatacggaaacctcagctttctccaatggttttctcagaacagtcagtacccctaaaatggcgagcatagcaggaataataaattggtttccgccaaaaaggataagacaggctactgaaagtccaagtcctgagagagcactgtaatgctttttctctttcatccattgttctatgaatatcacaataaacagagcagtcatcacaaaatcaagcccttcggtattaaacttcacgtacgacccaaaaatacctcctatcgctgcccccgcgacccaatataaatgattaagcagtgtcacaaaaaacataaaccagcccttgtcaacattcgccggaacattagcggtataattgatagaaaatgattcatcgcacattccgaaaatcagataaagctttttctttccagtccccctgtacttatccaacatggaaattccataaaacaaatgccgggcattgaccattaatgtcaaaaaaagagcattcatagggttgaacgcaccaagtaaaaaattcgctgcaacaaactccattgagcccgcaaatatcataaaactcatgatgattggatagattgcgctaaatcccaaagaatgcataaagattccataagctatccccaaaaataaaaaccccgcaaaaatcggaattgtatatgggaatgcagaacgaaatgcagcccatatttgacttctcttattcatatgagtgtttatagcaggagagcttaaatgtaacgattctttatttttattcaaatcaacaacctcctacatttcatcaattggcacacttacagttcttttttctgtactcatgactatgcttgtgtcaactccactaatagcagggttctgcattaatgaatcaatgataaaattccgataactctccatgtccttcgccacaatcttaagcatatagtcatggcttcctgtaagtgtgtagcattcttgtacctgtgggaatttgtttatatcctctaaaaatgaatgaattgtctccctatttaagggtgataagttgatgagagctagtgctgtgacttcgattccaagttttttctcatcaacaatagtcgtaaactttttaattatacctgcttctactaggttctttgttcttgcaaggcaagctgatggtgaaagcccaattttcttagataaattcagatttgatattgaagcatcttcctgcaattctcttaagatggccttatcagtttcgtcaagcataatacccatttcataacccccaatacgacttaacagaattacatttcatccgatttaaacaataacgaattttcattcgataatcaaatattttttaaatttaattccttttaaaatattattcacagaataaaattatccccatgattacctcataattaaattaacttacatcagaaagaagtcatgggagagttatgtacttgtgtgacttgataccaacatcataagaaacttatcagaagccaaaaagttattgcggtctcaccgaaaattgaatttgcggtgccctattgcctttttctgcgaacaaaaattgttaaaattcacaaaacagaaagtctactctattattattttaaattcgtcctctagttcctcttgagcctcttgtaaaacttctaatacatcatctgcgtatgaacctaaaaatgtattgctgaactcaaaatttttcaagactaaagtgagcggcaaatccacccaccctgtcaggcaatcccataaagcgtctaaatttctcccatagtagtctgggaagtctagtttatcttttaaaacatcatgtaaaacttctatattttcaaagtctcttccatctatcattatttttctcattagaaactatgccctccattattttatcttaacaaacgttttctttgtaacagctgtttgtccaaatgaggctgaaaacaaataaaaaacaccgatagggggaaactattggtgtttacaagacattttcatgcccggtaggcataaataatgctaaactttgtttttgaaaagctatcatatcaaatttttatgttacagcttttactatcgtttaatctaattgaggagtaaaacgaaatatgtttgaaaatcacatatccccaaaaaattaaaaactaagcggcagttcttcgattgctctcatcagaaaattccctttccatttcatttgttccttttcgccttttaactgtatatttggacagcggcgtaataaggtggaaatcgcaatcttggcttctaagcgggctaactgtgcaccaaggcaaaaatgattgccatggccaaaagcaatatggcggttgttctttctttcaatatcaaatatgtcggcatttggaaatatcttctcatcacggtttgctgatgctaaagaaatgatgatcacatctttccgtttaatctcctgcccatgcagtataaacggttcagccgtccagcgaattgtcgttagctcaactgggctgtgaaaccgcaatgcttcttctatggctgaattcatcaagtctggctgctggcggagcttttcaaattgatcaccgtgacacatcagagcatatgtcatattggtgattaagtttacggttgtttcatgacctgcaacgataagcagcataatcatcgagtacaattcttctgtacttaattgtgtgccttcactttccgcttgaattaatgcactgattaaatctcctgcaggttctctcctttttttgcgaactaaggattccagatattcaacaaactcccctaacaagtggtcattctcctgaagtctttcaggggcatctgaaaaatcaataattacttgcgaccacactctgaatttttgacgatcttccaagggaatgccgagcatttcacttatcacgataatcggcaatggaaacgcataatcgtctactaggttcatgaatttgttgggctgcactttatccaataaagaatctgcgatatgctggattttgtcttccaactgcaaaatcatccgatgcgtaaatgctttttgaacaagagttcgcaagcgattgtgatccgggggatctgaattaagcatatgttttgttaaagactcttcattcttcaatagagcaggacgtttttcttttgcggtaaatacattttcatagtttttctttaatttttcattctttaataaatgtattgcatcatcatatctcgatatgagccagcctttccccagagatcctaaagataatgggtagagaggctgtgattttcgcaattctttataaaattcatacgcttcatctttaaatgctctcgaagacaattgactttccgtcaagatggttacactctttttttcttttgaagacattcattcgacctccatctttatgaaaggttatgttaatctttaaatatataatcagtacgatttgtaaaatgatctattgagatcagtattcatgctaagggccaaaatgccgcccccgcattttgaaataaaaggtatgagacagtcattaatcattttgctgcccaaactctttccctgataagatggcgaaactcctaatacttctaaataccatgccggctcttttaagtatttggaatattttccaacttcattagtcacagtcactgtcaacatgttcaatactgaaaatcctcccattttgattaatgttatcccccctgctgctatataatcgatcaagttaatgtcgggtttatcacgatgttttaatagagcggcaacaaccatttcaccattactgaatgtcaacaaaaaagaaatgctttttaaaatatgctcttgtcagtactttatgcatttcaaaaataaatgaatgatctttttttcgcgttttacgagtaaatccataaaaggatattgattgaaagattcatggagtagctttgccacttagcttattcatctgccctagcttgtcgataaagaaacattgatacatctcctctgagcaagtaaagaaggaaatcgaattaaagcgcccttcctattggaaaggcgcctgccgttttactgtgccaaaatgtttttcatcagtgagtttttataaaatcatttattaattgatcagttgtcaatattgtggcaaattcatcatgcaatgtagctagagatatattatgaatagtcgccgcatcataatatgtatcattttggtctctcattccgaaggctgctgttgcatctgaaatcaggtatgtatcaaaccctaaattaccactcattcttgtggtggttgatacacagtgaggcgtggttaaaccagttatgactacagtgtttatttcatttaattttaagaattcttctaaattcgtaccaataaagctgctatttactgtcttggttataatgacttcttcatccataggcttaactatttcctttatcgcaaacccttcattctttggatggaataaagaatgaggtttatcagaagtgtgttgtatgtatatgactgtccatcctttttctctccataattttagtattttactaatattttcttccgcctttacgttattccgttccccccattttttatcatcgaaggctttttgtacatccacaatgattaaagcttttttcttttcttccacaagataccctcctacgtagaatttctatttattactacattctaaatacaaattttacttttgtacaattgtttaatgatgaatttcgaatgagcgccttctttattgaaaaatgcgttctaaactgcaactgtgcccaagccgttaaccttcaataatctaatctgagaatcactggctctacagagaatgataaaaagcactctaataacgagtgccgaaatgaaaaactattgatttagaagccatttgatacgctcagctgaaaagatgtagtggagtattattagacataaaaagacaataccaactggttttaaatgactaaaataaagcgctgcaacagccagtgcaaagatcaataattcaataactagccttgttaccccgtttacagctattacagtttgtccacttcgactaggatcattaggtactgcaaatacagaccagacaatcataactgcaataggtaaaacccaagttaaaacatatttaaaataaccattaaagcttatccaagcaaacacccctaaggagattagtgcagccatttcaagggtgaatcttaaaagtaaattagtctgattcagtttttccaactcctctataaaaaacacccccgcaggagatgctctttctctgctttatttcagcgtataaaaacttttctgttcttcctatttagattctattgtagttttcggcgagattacctctacttttgaaaagatgataccgactgctgctgttaccaatgctccgataatagaacgatgataagtataatgaaatatgacaacttttcccctcctatccagttaattatccaaataatcaggaagttgtctacaatttgcagaatttgtcgaacgaagtaaagaatataccataaaagctgaatattgacctcgcttatcgctgggaggctttactcattgtatgaattacagtaatacactaccttcccttttgagaagacgttcctctcttatatccatttgttgcaacttagctagactcttccaataggcttccttttggcgcagctgcttctagtcgaaattgagcaacacctgaatgtttcattggaatttctgaaccatagatcgttgctgaatttgttgcaaatgcatacataggagtagtcgaatggtggttgaaaaatgaaatgaattacccacctccagtgatggcagaaaaagcgggggttttgttagagaggaatctatagacatgtgtatctagaagatttgacagcattaaaatttatacttacatcgttgggaacaggccaacaataaagcggaagaacgtagtcatttgaagtggtttggaataaaaatgattcgaatatgttcttatcattgataaacgaacaaaaaaagaacatgttttgaaaaaagattgatcaaaacatcttcttatatgttgtcatagcgtaactttttataaaaaggttgattacattttcggggcttccaaaccaaattttgcccattcttcttttgctggaccataaatacctgaaacagttaaacctgcttgtctcataagaacagtcatttgtccccgatggtggttttgatgttgaattaaaaacatcaaaagtgaaccgttaggcaattgttgtccaataaagttgatacgttcttgaagtgtatggtcagtccattgggtttttaatgcctgtacaaatgcattactggcttgatgatagctgtcagctataaactgagccgaagttggaacaggataatcttcagctggggcatggaacgttaagtctgtgtttgaggtaatgatgcgaatagcagcaacagtgtgccaggcaatacggcctagagtccaattttgtgaagttatttcttgattaagtgattcatcagtcagactatttaatagtttctgtgtagcatctgcttcgaactcccaagatttcaaaaaatggtctaaggtttgaaacacaaaaatcctcctttttattcttttgttttttcaatgtgcctataggttaattataatgcctcgtttcgttaaaaagaacaaaaattttggacaagaataatcatagtaaaatgcgtagaccttcttaaacataacgatttacgcatctttttacaaacatggtgactccttggtctccattgtcagcgagaatcaaatatcatatgaaaacaatcctatattcttattactttactgagcaataaatctcttcggtatacttagtgatgccttcatcgtaatcaggatactgatatgtaagactttctgatacagcttttgaatactttctaaataatgcatagcaagtaaataaagacttccacatttcctgatacccattcacagaatatgtagacatgagttcctcccattctttatttgaaaggtaccgtttcataaatttatagttcttccccatactaaatgaataccctttctgagatgcgatatgccaggccatcattctcaataaattaggacgtacaatttcatttaaatggtcaatggcaaaaaggatttcatttcttgctagtccttttactacgtaagtcgaaaccatccagaactcattacagcaatcatcaaattcccttgcagtcggctttttcatccagtattggcgatcatttggggtcactttatagttgatgaacgaatccttatcgagcaagaccttaaccaaaccatcgttattagcaaaataatcttctgcttcacgaattggaataagggttagatctaatttgttcccatcctcaaaaagaatgatgtatgaaaaccaattacctaattcgggaggaaaaagctccatatcttctggtttttgcatcataatgcgcttcccaaagatttcgagccactgatcattttctttaaaagaatctacatcagttacaaaatacgagatgtcataatcttggaagttgtcaggagggatatttctgtttgtacgtgacccttccaaagtgaccaatcggattctctcatcgttcaaagcaaagtccaaaaaaatgtccatcatttcctgctcacttcgcattacatgttcctccgtttcagccttaatatctaactgtaaaaccgaatattgatctgtacgtcttatagatttttttactcttgaatgtgatgtattcttctaagctttattttacatgatgttctcctatatattattcaatattaagatgcaagacatctcaaaatcagatatcaactatgacggactacatgaatattcagttttttgtagagccgccatgggacgacactatctttgacacactttaatcccccctgctttatcgacatgttaactggtatgagagattgacaaaaagaaggaaaacgatatatttaagcgaatacgagtttttgagtaaattttaaaatgacacttttttcaaaaatcatgtcttaacggggggattcggtatgaatgaatttatgaagaagttttccttaacaaaaccgattattcaagctccaatggctggcggtattacaaagccccgacttgcatctgcagtttcgaatcaaggtgctcttggcagcttagcatcggggtatcttacgccagacctgctagaacaacagataaaagaaatgtttgagctgacagacgctccttttcaaattaatgtgtttgttccgcttggtctagaaatgccaccaaaagatcagattaaaaagtggaaagaaaacataccgttagctaatcaagtaaatcaattcacatctgtacaagaagagtgggatgacttctatcaaaaaattgatctaattttaaaatacaaggttaaggcttgctcattcacttttgatctgccgcctgaagacgcagtaaaggagctaaaaaccgctggatgctgtttaataggaaccgcttcaacagtagaagaagcattgttaatggaagaacggggaatggatatagtagtccttcaaggaagtgaagccggtggacatcgcggagcatttttaccttccaaaggtgaatctgccgtaggtttaatggctctgattccacaagcagcagatgcactgagcgtacctgtcatagctgctgggggaataatagaccacagaggagtaaaagcagctttaaccctcggagcccaaggcgttcaaatcggttctgcctttttaatttgtcacgagagtaacgcacatccagtgcataaacagaaaatactagaagcaaacgaagcagatacaaagcttacgacattattttcaggtaaagaggccagaggaatcgtaaataaatggatggaagaaaaagaacagtttgagacacaaacccttccgtacccttatcaaaatacactaacgaaggcaatgagacagaaggcttcacttcaaaataaccatgatcagatgtctttatgggcaggtcaagggatacggtcattgactgaggaaatttcggttaagcagcttttaaatcagctttgccaagaggatataaaaatataggcgcacctcattgatagagcaaaaagcaaacttcgacaggcagtttgcttttttttcgtaatttcatcccctgactttggaaatttaaatactcctacattttcaaagctaattgaatcgggttatcaatcatcccactgatacggtgcgatcttgatgatttcaccacaatacatcaccaacatttcgatcttatctccccttctccagttttgctccctattcgaaaaatcgatagctcccatattaaattcgaatagtaaaatggttctttttcgtttgattcagatgatataaagtcatatgataaaaaaagaatgagacagaaagcgtgagaagtgatgaaaataggattttttgattcaggaattggtggcatgactgtattgtatgaggccataaaagttcttccttatgaagattacattttttatgcagatacgttaaacgttccatacggtgaaaaatcaaagattaaagttaaagaatatattttcaatgcagctgaatttctggccagtcaaaatatcaaagctctggttattgcgtgtaatacagctactagcattgcgatagaggatcttcggagaaacttcgactttccgataatcggaatcgaacccgctgtaaagcctgctataaataaatgtacagaggaaagaaaaagagttctggtagttgctactaatttgacgcttaaagaagagaaatttcataatctagttaaagaaattgatcaccatgaccttgttgattgcttagctcttccaggactagttgaatttgctgagaactttgattttagtgaagacaaaatcattaaatatctaaagaacgaactatcttcttttgatctgaaacaatatggaacgattgtgttaggatgcactcattttccgtttttcaaaaacagttttgaaaaactgtttgggataaaagttgatatgatttcaggcagtgtcggtactgcaaaacagttgaaaaaagttcttgcagatcgtaatcagcttggtaaaggctcgggctcaatcacctttttcaattctggccataaaattgtagaccaagaagtcatatcaaagtacaaaagattgtttgaaatattagatgaaaatcaaaggagtcatgttggacattgaatgtaaggggctctggttataaacaatttttcagtaaattcacaaaagagagaagtatgaattcgggtttgttatccaatgtaaatgaaaaagacagtctcatgaagaaaaacatgaactaagaagcgggcttaaaaagcccactttttttctaacaaacaattgagttatgcacaaatatctgattacagtgttttcgctctttcccctcttatttctaccccatctctatagcttttctatttcaataaaacacaagtctcgattgaaaagttatcgtaacatttacacttcacaggacatttttcgagattagaaatcgaccgtttgccagatacacaaagtcataatgtgtaaattctgtgtctatttgcatgtttattatggaattattttcataatgttttataatacaagatgatagcgttttctaattataatgatagggggaaataatgatgatgaaaaaaggactgctcgcgggtgcgcttacggcaactgtgctttttggcacatgtgcagtagatgtgccgggtattattagtccaaaaaccgcagaagctgcatcacagctaactgatggaatcggcggaagggcttacttgaacagcactggtgccatttttgttacgaaaatccagcttcctagctccattcaggtttcaaatgggacagcctacatctactctggctttagcgggggcacagaatccgatatcgggcttcagtacagtgataaatataatgtatggaaaccatatatgaaagtcggttcaaaaggacaggatcaggttcagtacctcgaaggaggaagccaattcacgaatacgaaaggcttccgtcccggcagcaccgtacaacttaccatctacaaaaaccttaacggcaatacacgcgctacatactggggcacaaacaatgcgggatacaacggccgtctcatttcagagatcagcaaaacaaatgtcggctccatctccaaatggaaagcgctcgctacagttgcaacaacaggttcacgccaatctatcaaatcaaacttttcaacatcttttacaaacatcaccatcgacaacaaagcaataacacctgtaattgatacacaagacttcgctaaagtaacagtctcaggcaacagtgtcagtttatccgttgtgaaaaattaaaacatgttaaacatacaatgcgttaggctattgagaagctctcgatagtcttaaagggggcttaacatgccccttttttcatttcaatttaactttcagttagcttcggtgcatgccgtctatccccgtcttttatctgggtgaagtaaggagcagctcgccccttctgagcctgttccatttgctcaacgcaaaaggtgtgcattactgtcttaaaaatgttaaaacaaatggcagatggtgcactttatttttagatgaggcatgcttacgctcgatatgcaagtcaaatgattaagggtctgcaagagagagaagttttgggtgtactttcataaaagagggatgtcttcatatagctcgattgcaccaggaacattaaccagcgattggccgagaacaacacatcactttgaaacggattcattccaaaataataagtatgatcaataactaataaagatcagttagcagtccagccttaaaaatatttttacatcaagtaaactagcatcactatcgaataagctcgatctgcatatcatgtactatcctcttttaaggaaggtgatgttatgaggtcatttccattaattgtagttctattcatcctattaatcatcgttgggacatctttctttggtggctattaagaacacaccttacctcatatccatcagacgccataagaaatctttatggtgtctgttttttattagatttaaacaaaaccattaaagtggggccatgcaaacacacctatggagattactgccacgacttctttgtgagggaaatattcttccctttatggactattgtcgatcaaaagagaaagttgaaatacctttttatggtgagatgaatcgaggcttagacatataaaaaaccgcaaagctttcttgaagaagctttgcggtctttgggtctcttctttgcttcatataagccaatagatttcaagcgtaatccactgccatacatccaatgattttttattttgaaataggtttcttctactcttcctgtgagatgactcaaggtatgccacgtcacaataatgtggcggatcctgagtggtctcaatcagttttttccccattctatcaattctccacagaaaaaatggctatggcagaacaactttcatagagtaatcatcatttaatgagccatcatctcatgggcaatatcgtgtccatccatttttgacgggtagtaggtaggccaatttttgacttcatcaagtaaagcttcacggtcgtccccccaatagagatgataatgactagctttagtcgggtaaatactatgatcactaaactgaatatactgaggcagctcttctgcttttttagctagtttgaatatgtatcttacccctctattgcccgcatcataggtgagaatttcgtacccgtcatacgtatacttaccagaatattcttttccatttttgaagaacgttacagtatctttctggattacaatacggtcaacatctgtttgatagccttttttataatactctttatattcttcagctgtcttgccgccttcgtgttctgatttatatgaaaacacttcgtcaagagtaccatcttgcaggtatggatatacagattgccaatctccttcccaatcagaaagtaagcgatcctttacttggctgtttttaaaatagccttcatatattttttctgtttcttcatcatgcgcatgactatgatcgtgagaatgttcttgtgtatgactgtcagatgtttgctcttgcgttttggaagagtcttcttcaactgctgaggatgatgttgtttgattagactcacctgcagaagaaccggaagtctgacatcctgccaatacgagtaatgaaccaatcgttaatatgcctagccgctttgaaaataaaatgttcattccaacactcctttttattaaatcgaaaacattacgatttatattatacatacatctcttgcaaacatcaaagggaaaatgctcttcatgcggatggactattttaaaggaataactgactttgttcatcagttattcctttaaaatacgaaagtctacgatatttccatatcgatccgcttcaatattacagcacccctcaagcagctgttttaattttccccgtccgcgttgtacccttgattttgctcctgagtaagaaatgccgagcttttcactcaactctttctgtgataacccctgaaattcagttaactcgagcgcctctcgatacttttcaggcaaccgtttgatggtcgatcgaatacacacagttgcttccttggtgaaattttcttcctctgcacggttattaaaatgtagatcatcaggcaatatttcgcttgttttttttgtacggtaaaaatcaataatcgtatttctagtgatccgataaatccagctgtcgatcttttgttcatcgatcagatttgggagatgcacttgtattttcataaatacgatttgcaagaggtcatcaacgatagattgatcgttaaccctttgtgaaatatatgtttttaacggctgatgaaattgatcccatagatcctctatattcatttgaaaaaacctcctataattttgcgtctgctttacatttgcttcgtctttttaatcgtaacaaagagcgaaacaattgttgaatcaattgtattgcagctgttgcaaaaaataatgataaaggagaggtttgttgtggagtatacctatttagggagaacaggattgcgggtgagccgtttatgtttaggcacgatgaattttggagttgatacagacgaaaagactgcgttccgtatcatggatgaagcgcttgataacggcatccaattttttgatactgccaatatttacggctggggcaaaaacgcaggattgacagagagcatcattggaaaatggtttgcacaaggaggacagcgccgcgagaaagttgttctggcgacaaaagtatatgaaccgatttctgatccgaatgacgggccaaatgatatgaggggcttgtctctatacaaaatcagacgtcacctggaaggatcactgaagcggcttcagacagatcatatcgaattgtaccaaatgcatcatatcgataggcggacaccgtgggatgagatatgggaagcttttgagactcaggttcgctccggcaaagtagactatattggatccagtaattttgcaggctggcatttagttaaagcgcaagctgaagctgaaaaacggcgattcatgggactcgtcactgaacagcataagtatagtttattagaacgaacagctgagatggaagtgctgccggctgcacgggatcttggtttaggagtagtggcgtggagtccccttgcaggagggcttcttggcgggaaggcattgaaaagcaatgccggaactcgtacagcaaaaagagcagatttaattgaaaaacatcgtttgcaactcgagaaattttcagatttatgcaaagaactaggagaaaaagaagcaaatgtggctttggcatgggtgctggcaaatccagttttaactgcgccgatcatcggaccccgaacggttgagcagctgcgtgatacgataaaagccgttgaaatcagtctggataaggagattctccgcatgttaaatgatatctttcccggacctggaggagagacacctgaggcatacgcctggtgatacattcattactcaatactgacatttttcttaaatatttatactgaactatcatattaggaaagacaagagcttgtttgtctcttgtcttttccacatcatgttgaaaatgctggctaaacatcgacaaaaatgctgccgcttctaaaaaagaaccctaaacaatagagtaactggaaagacaactggcttgatcagcttgggacccctttcagctgtatttaaatcaatcaaactaatgattcattggcagtctaaatattattattgtttgtttacaaaatagtaatagcccctgtaatgattgctaacaacgtaataactaatgatgtaattacagcccacttaacggcaaacctttgaaatgaccccaagtccattttaagcatacttactaacagtagtgttgacgcaactaatggactcatcagatgaaccggctgccccattatagaagccctcgcaatttctactggttctataccatatgctgaggcagcttctgcaaagataggtaccataccaaagtaatatgcatcatttgataaaacaaaagtaaacggaatactagtgagtgctacaataacggggaaaaaccctcccattgatgagggaataacggatattaatgatcctgctatggcatccaccatctttgtcccggataatataccagcaaatactcctgctgaaaataccaataatactacagttatggcattaccagaatgctcggcgattcgctccttctgcatttttacattcggataatttatagtaagggcaagaacaaaaccaattaaaaataaaactgacggatgcttagttccaagcacaataaacaccatgatacttataacgaggaataaattaagatatattaagcgtggccttttcaattgctcgctctccaaactagcagccatataagattgagagctgtcctttgttatatgtctaggctctaattgaacgatgcctattcgattcctctctttccttcccattagaaaagccagaaatatcacacaagcaatacctccaagcatggtcggaagtaatggcacaaaaaaatctgaaggatccaaacccagcactgaaatcgctcttgtagctggtccgccccatggagtcattccgctaacgatactcaacgacagcattgctaatgtcgccataaccatgggattcataccaattcttttatacaaaggtaacattgctgagactgttatcatataggttgttgtaccgtccccatctaaagcgataagcattgccaagacggcagaccctatcgctattttcacagggtctccctttactatagataaaattttttctattagcggatcaaataaacctgcatcaattaaaattccgaaaaaaagaatagcaaacaatagcaatgccgctgaacttgcaactgtttgaattccttctaaaatcatgtcgccaatacccttaccaaaacctccaataagagcaaaaacaatgggagtgatggtcaaggcaacaataggcgagactttctttgtcattattaatattgtaaaaacagttaccatcgaaaaacctaaaatagtaagcatattacacctccaagaatgcgctttcaaatgacttttgattaacatatcttatacggtgtaataagttaaataaatatttttttactgtgtttcaaaaaaaattctatcataactttaaatggttaccatttgttcaccctttaaaaaatcaatgaatgctttaacgagtttgattcctaatgatttttgatcgtacattagccaagtatctctcattagaggcttacccttagcattatacagttccattgtgtacaaatgatcagattcctgcaggcaaatttctggtgctatggagtaaccaagaccatgctttaccatctctttgcaagtctcttgtcgatccacttccattgcaataatgggggcttgttttagattcgtatgcatccaatcttctataatcgtttttaaagaagcatccgttttatatttgataaaaggtaaaaaaggaagctgctctatcgttattggtttttttgagatgatatgtaatttttcccgtgtcagccgttcctccacccctttccagcgatggcttcctctcagtataccgacttgtacaataccagcatctaataatttcatgacatctgtgctccagcctgtttgtacactatattggacattaggatacatagtggaaaattcccttaataacttagggagcttatattgagcgaaattgcttgatacccccagccttagatgtccttgcacctctttgcttagattagagatatgatctttggtatcttgaagttcctgtagcattcttcttgcataagcaaccaagtgttctccttccgcagtaaaggtaattcctttatgccttttggtgaataattcaattccgaaaatctcctcaatcttattcaaccgataagtgatggaaggctgtgatgtaaataatcgttctgctgtttttgttacactttgttcttcgtgaagaattttcaataaaatccaatctttctcatccattttcatcttcctttctagtccttctttcacaattataaaagtttttttatcgaatattaagaaaacttatattttatttttatttttttaccttctacactaaaaaacataaaaaatactacctttaagatgaggatgatgacgatggtcaagacgaatgtaacaatcatgagaggcggaacaagcaaaggcgtttttttccacgaatcagccatgcctaacaataaaaacgaatgggagccctttttgcttgatgtcatgggaagtcctgataaaagacaaatagatggtttgggtggcggtaattcccttactagtaaagtggcaataataaagaaagcatatacttcggatattgatgttcactatactttcggtcaagtcagcatttcggaagaaaaggtggactttaaggggaactgcggaaatatctccgctgctgttggtccatttgctatcgaagaaggacttgtaaaagcgacagaaccaatgactgcggtaaggatcctgaataccaatacgaataaaatgatcattgcggaagtggaagtggaagacggtcaggtcaaatatgacggagatgttacgatatctggagtgcctggatctggatctccaatctatttaaactttcatgatgccgctggttcagttaccggtcatttattgcctactggaaatagttcggagtttttagatacaagtcaaggccaaatagaggtgtctattatcgactatgcaaatccattagtttttgtggaagccagcagtatcggcctggagggaacggaacttgcagaagaatttactgatttacagttggctcaatttgaagaattaagatccattgcggcagagaaatgcggctttgccagtcgattttcagctacaaagttatcgccggctgtccccaaactggctatagtagcaaaaccagagaaatataaagatagtacaggtgcttggcattcaagcgttgagatggacttacacatcaggatgatgtccatgcaaaagccacatcaagcactggctgtcactggagcgatatgtacaacaagagccctttcagtggaaggtgcaatccctgcaagaatagcaaaaaaccactctacaaaggttcggctagctcattcttctggtattattgaaacaatggtggagcccactggtataaagatcgtccgtaccgcacgacgtattatggacggaacagtttatacgcatggagactatcaaatgatgtagatggactgtgcaaaaagcctccccctttccatcgttaatagatggattgaatgcgccttcttgcacagatccattgtaatcttgcatggctttaaaaaagcctctatattgtattttatgaaatcgccaaggtcctttcatgtatctgcctcaagcatgacataatcattatagagaaaattgaatactttttactgcaaataaaaagataccaacatcattggtatcttttagattgagttcatctgcagcggtttcttttcctcactgcttatttgattacaaaattaccgtactcgtttgaacgaacatgaatcggtccgtttagattatagttgttctccttggcgatagagcgaagcacgtccacacgggcaactgattctctccattcgtcacgggtgtcatgattggccggattcatcagatcgtcatagcgtacgtccaagaatttattcaaccacttcttctcgtctattccgtctttaggtgatccgcccgcttttttgttcgtacgtttaatcaaggcataaaaagagtcagggtcatcaccatcgccatgctgaataaccgtatcgtacatcacagctctagccaatgctgtttttagtccggcattatccgatcgtttcatggcaggctgataatacaaatggtcatttactttgtcttgagcggcgcgaaattccttatcatttgcaagcgacttccaggcagaagcgaatcccttgagattgcttgtatcatcgctttcttccttggccagacggcgcaattcagtcagatactttttcagtttgttattcggaactgcctttgtgtatacttctactacttccaatgcatccccggtagccgttgtaaagcccgcccgtccgcatgtatagcctcgcccgtcatccaatcgctctacatatccatattggatctccgttgtgccgttttcaaagatacttgtcagctgttccgcccggcgcttttgatctttattcagtcccgccgcaaaaaccgtttcgctcatcatcagggtaaaaaacatggtgaaaacaagtaatgagatcgctgcttttttccaaaaatctgctttttgcatactgattttcattttacttcccctttctaaatattgtaaatacagactcagtatacatgatgaaactgccctattgttgaaaatacatcaatttgtaaatattttgaatctaaagtaatatagcttgaatcttactcttttcattgccaatcagccttagcccctctcactgggaaggtccctttcatactgcttcaactttcattaacaagatgccataggctttactctattttataatggaagtgatcatcgaaaatcgttagggaggtgatgtaaatggcaagcaagatgagaatgccagattccgcaacgtcccatgcaaagcctactattgggaaggcgatactttgcatggggtagactttctaaaagatcgcccaagtaagcttttctgatatagtggctttgcaccttatttgacataaaaaaataaggagctggcagaaatggcatatgtaaaagcaaccgctattttacctgaaaagctgatatcggaaattcaaaagtatgttcaaggaaaaacaatatatatccctaaacctgaatcctctcatcaaaaatggggtgcgtgttcaggaacaagaaagctgatcgatgacagaaacgcttctattaaaaaagcatttaaaaacggcaaaaccattcatcaattatctgatgaatatcacctctctattgaaacaataaaaaaaattgtctactctaaataaacaaaacggaagcactgataaaaaataatcagtgctttttatatggcgagtttgtttcttagttatttcctgcatatgataccattggccaattgtgtaaagttaagggagatgagaagaaaggaaggtcctacaaatgacgataaacaatggaacgttgcaagtacccggcgcgaacatccactatcaggtgcgtggctcaggtccaatcattcttttggtccacggcggaggcggtgatgccgacaagttccatcatgttgccaatcatctggctaactggtactcggttgttacttacgatcgccgcggccattcccgcagcaatctcgccaatcagattgaggattaccgtgtggaaacacacagtgacgatgctcaccgtcttctagccaaaatcaccaataagccggcctatgtatttggaagcagctccggggctgttatcgggcttgatctgtgcatacgccatcccgaacaagtacatgtcatgatcccacacgaaccaatcttattgcagcttctgcatggaaatgagctgaaacaagccgagcaattcatggaagaccttaagaaaaatcatcaaagtgaagtcattaagttcatgtcaagattagagacagacgaacaatcaaaggctgtgctgacaaagcggcttctcggcaattcaacgtatttcactgagtatgaaattcaaggaattctcagctatacattagatttcgaagcattaaaaactgtgtttacatcttcaccgatgaagatactcccagctggcggaagtgcttctcgggagctttttccttatcgttgcgcgaacgccctagcggaacaattggaaacagaatttgttgaattccccggaaatcatacggggtacacaatgtaccataaagaattttctgagaggttacacgacatgttagaaaaagaaaataaacatacgtgttcaaaataggacaggtaaaactaactatggaattggagaagatttcacgaagcgtaaaaagaacttttcactaacgagaacgcaatgtgagatgtttaaccaaagtgatattagggatttcatcgaaaaataggtttgtacattacgttctcctattgattatttcctatcttaattccgtattttataccattagatacaactctaaagcggctcgttattttgtcctcaacaacaaccagtgtctaacatcatgaatctcttttgaaaatcaccacaaatgcaggtatggaagacttcatcgcagcaaaaaccataccaactattgttgttggtatggttcgtcctagataggcccttaagaagagattctattgtacggagtatttagctaattgcatttgtaaccgacagggccgtctgaacctgtgtacacatatgtgtcagacacatatccaatattcacgacaccccgggaatctttccactggatttggtcccagatattactcgttccatacttccctgtaacagtcgttccataagcgtaacaataataaggaacacgggagccactcggaatggaaagcataataggataatttgtaccaggaccgctgcgcatattgacaggcgcaccgctgcttgttgagacagtaaagtactgcacggcaagtgcctgactggaaaaaatgaataaagatgcaatcatcacggttaacatactcagcattttcagtttagtcaatgtcatccctctttcttcaattccttcattttaagaaacgatagaacaatgctaccagctgcatttaggaacaaccggaccgtctgagcctgtatacatatatgtatcagagacaaatccaggaacgatctccccgctggcaagcgtccgctctgtgtaattccaaatgttactcgttccatactttccagttacagttgtaccggttttgtagcaatagatcgggatgcgggttccgctcggaatagtcgttacaattccccaacttgtacctgggccgctgcgcatattgacaggagcaccgctgcttgttgaaaccgtataatactgagctgcaagtgcatggctagaaaaaatgaacacagatgcaatcatcaccgttagcatacttagcctctttagcttattcaccttataccctccccttataaatgccgtacgtttgactttcttacatccagttaaggatttactttcagataccatgccccctcccctctcatatatttatcaatgtaccataaactagatctttcaaaagtggaattattcctatgttttcgacaattaaggatacaaaataaatggtagtcaggcttgatattgatggtgtgttacatttggcatttgtccagtcggtaatcacgattgacaatcaggaaaaaggacatggatcaagcggtttcgtgtccaccaattaactcaatcagtgtacttctgccttgtatccacgcttcttctcgattcatagatactccacctttttcaccaatcaaaaacggacaccaaacaaatcagcgtaaatgctgcaagttcagtgtccgcaacctattatgactttgctttcttttaccagggcgtataaaaatgattaggtacgttatcaaacgttatattctatgattttgcgagtcgaaaaatcataacattttatatatttcaatcagattatgatctggatctctgaagtgagcaactcgggcactccattccttgcgatcatgcggtttatttacacatttaactcctttttcgtgtaaatcgtcatatgttttatcaacatcttctaccttaaactgaagcaaaaattttgattgagcttctccttccaacgattttttttcctctccaacgatttcagccatcgtttcacgagataaaagctctattttcgtttccccattatcaaagagtgcatattccatttcattctctaaccaacttattggaagtcctaatgaatctttgtaaaactccacgcttttcttaaaatcattcaccaacagtctaatttgtaacagcttcatatcgagtgcctcctataaaaccatactttttactggtcatccaatttaatgatacaaaaggaaacctgacagcactatgtcaagtttccataaataaatttcctacttcacctttatttcagatttaagtgcagtttattccatgtcataagaaatgtacgctaacgagcaaaaacagcgattcttaaaacaaaaaatgataccgagtgtattttctgtatgcttcaacttcatttcgggaaatgtaacgttgataaaggaggttacatcaatatggatcatcaaacattggcagctcacgaggctgttgacttacatgaaatcgtgaactttaaaacactttgtatagcgaaatcaaagttaatgcaaggacttgtgtttgaccaagaactgaaggacttgatgcaaaaagatgtacagcaatccattcaagaccttactgaattacaagcggtttatgagcgtgcctcatttcaggcccctgtccctcaaagccgcccaacgccaatcatcaattgaaaggaaggtaagcctctttgaataatgatcatttagaccccattaattcgctgaatgtgcctgaactagcagacactacattcgcgatggattttcttatacgagctaaggaaggcgtaaggaatactgctgtagctttgacagaaaccgcttcaccagatgtaagagccttgctgcggaaacagctgatgcaaggaattgcaatgcaccaagagattacggaactgatgatcagcaaaaaatggttccatccatatgagctgagcgaacagtataagctggatcagctctctgcaaaaaacacgatcatggtcggcaatatgaacctcttccctgatgaaacaaatcgtaaagggatgtttgaccggacacctgatgaacactaacactggaggttttacagcatgaaggcagtaacgtatcaaggcattaaaaatgttgttgtcaaagatgtccccgatccaaagattgaaaaatccgatgacatgattatcaaagtcaccagtacagccatttgcggatcagatttacatttaatccatggattcattccgaatatgcaagaagactatgtcatcggccatgaaccgatgggaatcgtcgaagaagttggttctggggtgactaaactaaaaaagggagatcgggtaattattccctttaatatagcatgcggggaatgctttttttgtaaaaaccagctggaaagccaatgtgatcagtctaatgacaatggggaaatgggtgcttatttcggctattcagggcaaactggcggttatccaggcgggcaagctgaatatttaagagtgccgtttgcgaattttacccattttaaaatccctgaatcttgtgaggaacccgatgagaaattaagcgtgattgccgatgccatgaccaccggcttttggagtgtggacaatgccggcgtaaaaaaaggcgatacagttatcgttctcggctgcggaccagtcggcctgtttgctcaaaagttttgttggctaaaaggcgcaaaacgcgtcatagcagtagactatgtaaactatcgcttacagcatgcgaaacgtacaaacaaagtagaaatcgttaattttgaagaccatgagaatacagggaattatttaaaggaaatcacgaaaggcggagcggatgtagtcattgacgctgttgggatggatggtaaaatgagcgatctcgagttccttgccagcggcttaaagcttcatggcggaacgatgagtgcattggtcattgcttcccaagctgttcgcaaaggaggaaccatacaaattacaggtgtgtatggaggcagatataacggttttccgttaggagatattatgcagcgaaacgtcaatatacgctctggacaggctcctgtgatccactatatgccgtacatgtttgaactagtatcgacaggcaaaattgatccgggagatgttgtcagccatgtcctgccgcttagtgaagccaagcatggctatgacatttttgattcaaaaatggatgattgtatcaaagttgtgttaaagccttaaaaaacggaggttacagaaatggaatacgccttacacgaagtgcttgaggttcaggaaatgactgcatttaagacactttgtttgacgaaatctaaaacaatgaaagcactggtatctgatccgaagctgaaagaaatcatgcagcaagatgttgatatcaccacacgccagctgcaggaatttgcctctattttatctaatgcaaagcacgaatgaggagatgaataaatcatgaatcctatcatagaatatctgactggcatgaatgttctaacagaccaaatcattgctatggacttattaatttcagcaaagaacggagtcagaaattatgcgatggcagccactgaagccggaacgcctgaagtaaaagaggtccttatccgccatttggaagaagcactcgatatgcacgaacaactctcaagctatatgatggaaaaaggctggtaccatccttggaaccctgacgaacaagtcaagctgaatttaaaaaatattgatacagccattcaattgccaaccctttaacatacaatgactgatttgctgaggaacagtattgattggccacaactgttcctcagcttcaaaatgagcactgtttgttcgggtcctatgaccgtaaatagattaaccgcttttctccatctgatctccgataatgtttgcaaattctccaatccaaataaggaatcgtaaccacctctttttatgcgatctcttgatggagaaaacaggccagaaacaaaatccttcgtttttgacctgccctcttcacacgcaaagaatgctaccttctttgctccactgatccgtgaagactttccgttttaggcctgcttttgagctttgcctcattttcacgcaatttcccatcataatctttaatttttgtgtctaatctcttaattgtttcatcaatttctttccgcttctctatcagccgctgtcgttcgtcagccaggatattttttcgagcttctaccgtacagtcaccttcggtaaataatgttgtatattcaattagcgcttctatcgatagtcccgcatttcgcatgcatttaatgaattcaatccatttgatatcttcttcatcatagtcgcgaatgccgctgtcttttcgttttacaggcgggattaatcctacacgttcgtaatatctgagtgttgcggctgtcaggccaaactgctttgccacctgagcaatattcatgatcttcacctctctatcctgcatgttgtgaaggtaacacttaaagttaactttaagtcaagctcaagacaagtggttagctgctgaatctgggtttatatattcgggacttgccttaaagcacactttaagctctatacttctccatgcaataaaaacagtgtagatggagggattgctgaatggcaaataaacaaactgccggaagagaacaaaccaaagtttgcttaacttcatgatgatgttctattcggtgacatttgggaaagagaggaagaacttccccccgagatcgcagcataattacagtttctacgttaattgctgactgtatctcaacttataaatcaggttcattttaaatgttattttaaaaaaacccttgccttaaagcagactttaaggtttatcgttatgttgaagacaccataaaacataaataagtgcatgtttttttacaacacttatgatgaagaaagggaaggttcatatgtgtaatcaacatcaaacccgtgtattaagcgtgtcacatgcaaaagccaaatttgaacaaacgacgattgagcgaagaggattacggccgcacgatgtcttaatcgatattaaattcagcggtatttgccattcagacattcatagtgcttttgatgaatggggcggtggcatcttcccaatggtgcctggacatgaaatagccggtgtcgtaacagccgttggagcagaagtcaccaagtttgctgtcggagaccgcgttggtgtcggctgttttgttgactcttgcggagaatgcgaatactgtctcaacggagaggaacaattctgcacgaagggtgttgttcaaacgtataactcagtagactacgacggaaaccccacttatggcgggtacagccaaaaaatcgttgtcactgacagatttgttgttcgcataccagatcgtttggaaatggatgttgccagtccgctgttgtgtgcaggtatcaccacgtattccccgctgaaacactggaatgttggccctggtaaaaaagttgcgattgtaggcgtgggtggccttggacatttggcgattcaatttgcacatgcgatgggtgcagaagtaaccgttctgagccgttccatgaataagaaagaggaagctctggaactcggtgcaaatcattactttgcaacaagtgacccagctacattcactgcattggccgggcgttttgacgtgatcttaaatacggtatcggcaaatctcgatgtagatgcctatttatcaatgcttcgtatagacgggacacttgtaaacgttggagctcctgccaagccggacacatacagtgtgttttccctaatcatggggcgccgcagcattgcaggttctctagtcggcggaattcaagaaactcaagagatgctggatttcgcagctgagcatggcatcgaacctaaaatcgaagtcatcggagctgaccaagtggacgaagcatacgaacgtatcctccgaagcgatgtccgttatcgatttgtgattgatatttccacattgtaataggttattccttatatggggctgacccgcttttattgaaactcacgaaaaacgatctcgttaagcaaatattttgaaggccggtcaatcttcctgttattctatgaatagagagttattaggagggttttttatgagcaaaaaaatcgcagttcttgttacagaccaattcgaagacatcgaatatacaagtccagtaaaagcatacgaagaagctggctacagtgttgtggctatcgatttggaagccggcaaagaagttaccggtaagcatggcgagaaagtaaagattgacaaagccatctctgatgtggatgcaagtgactttgatgcacttttaattcctggaggattctctccggatttgcttcgtgcagatgaccgtccgggtgaattcgcaaaagcatttatcgaaaacaaaaaacctgttttcgcaatttgccacggcccgcaagtactgattgatacggatcttctaaaaggcaaagatatcacaggctaccgcagcatccgcaaagatttaatcaatgccggtgcaaactacaaagatgcagaagtagtcgtcagccacaacattgtcacaagcagaacacctgatgatttggaagcatttaaccgcgaatctttaaacttgttaaaataacgagaaggcacagactgttcgggtctgtgccttttttaaaattaagactccttctttacattctgaaagacagcagtcgcgtcccacacattcaagccaaattgaccttctgaaaatgcggaatcatttgcatcaatcacaaggcgatcatctaaatagattttaaagcgatcgccctcggcctctgttttcagatgatacttttgattaacgtctatcggtgttttgtattcagcaatgacagaagcaacaccgttctcaaatttaaagaatttcactagatcatgctttgcatccacattggcaaggtaaccgtttttggcatctttgtcagagcgaaacattagtgctcctgcccctcttccgtttccatccttaatggtgatatcagattcataagtgaagtctgacccggatgctgaagacaagataaaggaatctccgtccgacctcccttgtttcccctcaattgtgtcggcccatgtgccatttacagtcgtccagccagtcatattggacataaaaggtgacgttccccataccttttttaaagggtgtatggttaaagattttacctttacgccgccatttgcagcatataattcaagccctttgcttgatcggtctgggagaataatatccgttatgacctgctttccgtcattcccaaatacttcaaccgaggagcggtcaacaaaaatgcgcatcttaaccttcccatttaccggcttcaatggggctgtttcttttccggtgttaaaggccggattaaaggtattgttgcccgactcgctccggtcaacgaacaatttggcgttccttcggtcatagccgaccttcgtaaattgattttcacctgttcggaccttaaaaccaaattcagcagctgaaccagggcttactttaaattctgcatttatttcataggcatctccagattgccccgctaacacattatgacttgcaggcgatatggtcagattcttccacttcttagaggttccgcgaatggtttccagctctttcaccggtgtttggaccactctaaccccttcggtaaacgctttcaattttaactctcttggaatggacgttgcacttctccatggggatgtcggaacatcattcgcatattgccaattgctcatccaccctaaccatagccggcggctgtctgtggatggaatatcagaccaggatacagccgcataaaagtctctgccgtaatccgtccagagaactttgtttggcgggttttcatttttaaaatgagttccatcaaagtcccctacaaaatattgcatgcctgatcctcccgagaccgctccgtttccgacactgacctgcatgacccatttcttttgattcggattgccgtctaccggaagctcaaataaatccgggcattcccatactcccccgtggcttccttgatcctgtccaaattcacttgcatacgtccactgcttcagattttttgatgtataaatgaggattcggtcaccggccgcaagcaccatcacccactttttttctttctcataccaaaagacttttggatcgcgaaaatcttttttacccgggtttggaatgacagggttgccagcatacttcgtccatgttcttcctttgtcgttgctataggcaatactttgcacttgatggccttcccgatcctgtgtataaatggccacaagcggcttctctttgcctgtttgaaaaccgcttgtgttatttttatctacaactgcgcttccagaaaagatcgtgcctttttcatccggatacagcgcaacaggaaggtgttcccatgtaaccaaatctttgctgacggcatgcccccaatgcatgggcccccactgaagcccgtatggatggtattgatagaacaagtgatattccccagcataatataccattccgtttgggtcattcatccagtttgcctccggtgtgaagtggtattgaggacggtaatcctcatcatagtagcttgaatcggctgcatctgccgaaaatgccatagtcaacagcagggtgaacatgatcatgacttgaataagtctctttttcatttgttccttcgctcctctcttcatgtttgaacactttcaagagagactgctgcgcaagctggtccgtttctggcaattctcctctgtttcactgttatccgaatgatttatatatgaaaagactgctgcagtttctctctctttccttcacacaccttatgctaagaatccagcccaatacccgagaatcccgatgacaaagatgccgcaaataatgagaagtggattcacccctttgcgaagcatccatgccaccaataacgttaatccgagaggcagcgcccccggcataatgctatctagcacgttttgtaccgtttgaacatctacttttccgctttcatccttaatcctggatacaacgattggaatgttgatggtggtccatttggacacgagagcccccataacaaataacccgagaatcgaagcgccctctgtaagcttttgaatgcgattccccgctaaatcctgaagaatctccattcctttcacatagccatactttaatccgtaatattttgtgcttaatcttatggcattcagcaagaaaaagaatagcaaagggccggcaatgtttcctcctaaagcaagggaggctcctagcgcagctaagacaggacgaatcgttccccaaaaaattggatcgcctacgcccgctattggtcccatcaaaccgattttcattccgcttatcgcttttccgtcaattcctttattgttcgccatttcttcttccatggctgccgtcacgccaaatataggcgctgtcagccacggatgtgtattaaaccattccaaatgccgctgtaaggcttcgtttcttttcgctccgggaccgtacaattttttgatcgccggtatcatgacataacaatatcccattgcctgcacacgttcgaagttaaaggaaccgagtaaaaaatttgaacgaataaacatgctgaaaatttctttcttcgttaatcgtttttctttctccattttttcttccccctcatcgtttaggcatcaagatcatcatcatcgtcatcataaacagcaacactgccactgtctgatgcggccgcgactgctccgtgagcgctttgtttttgcatcacctgctggtataaaagcgccagacagagaccaagggctccaaatcccactaagttaaaatcggtaaacgccgctaataagaaaccaatatagaaaaatggctttaaataaggaatattcatcatattgatcaccatggcatacccgactaccacaataatgcctccgcctatttgcagtccttttgtaatgacatcaggaatatttcccaggaacgcctgaacagcgctgacactaattaaagcaacaatcaatgtaggaatcatgacgcgcaaagcttgaaacaccatcgcggtaatatgcataatttcaattccttttatatttcccgcttttgcatattgatcagcgcggtggatgaaaaagacagtgatcgtccgaacaaaaatcgtcagcgcctgacccgcagctgctaaagcaacagcgacagcaatcccctcgccaattccttgatcagcggtaataactaaaatggttgagatgacagaggcgatcgctgtatcaggtgccatggcaagcccgacgttcatccagccgagcgccatcagctccagtgtgcctccaagaataattcccgtttttaagtccccgagcaccaagccaaccaacgtacaggccacaagcggccggtgtgtctgcccttcatccaatacacttgcgattccggtgattgctgcaatgattaacaacaaaataatttgtaatgaagacatattctcatccccttgattattttgctacgttccgtaaaatctgtacaaaatcctcactggcatctgaaggcagctgcctcaattccagtttcacgcccttgtcacttaatgtttcaaatgcctttatatcttgttctgtgacactgactgattttgtgatttgcctgcgatgattttcaaaacgcattcccccgacgtttacggttttgatcggtacacctgcttctataagagatacaatatcggacggattttcaaacaagagcattgccgttaccccttcgtagcgcggactatgaaatgcttttgccattttagaaaccgagacggcactcgcctttacatttgaaggcgcaacagaaaggatcagcgtttttctcatttcgtcctgagcaatatcgtcggagacaacgatgattcggtcggctgcatggacttttatccaccttgtcaggatttggccgtgaataaagcggtcatcaattcttgctaacacaatgttcatcataattcatcctctcttgtatcttgattggctgtttttactttttctaaatgttcactgcacacttgaaagctttgctgactcattgcttttaagttgttcagcaaatctttgagagccagatgttctctcaggcttaatacctccagcagaatcggcaggtttacgccggctgccatatccattctttgatcctcagcaataaaggaagctgccgcgttatatggcgtccctccaaaaatatcgactaaaaaaagcacttcatgttcttccgggatatccttgagcgcctgatgatatttttcttgcagcgtttgtattccttcccctttaaaaaacggcactgcaatcaggttattttcttcaccgaatatcatccctgaagattcttttaatgctatgggaaaatctccatgaccgctgataataactgaaatcatatctattgctcctttcctgttttgtacatccatatataatgcaaggatcgtgccaacacagttgtgttaagcgttttcattgttatttcagccaatagcaatttgttgtcgaaacacttaaaacgaaaaaaataaacctgtattaaaatggtgttccatttaatacaggttcatataaaaaaactgtttttaaaacagctggccatgcacttcttcagcaaatatggcggctataaataatttttcatcatcacttatgcgaagtccgagcttttcttcataaggggctaatgttcgttctgtcacgtacaccatttccttcagctgatcattgatctcttcttcctccgagaaagcgatcggattctgcttaattaccctttcaaaggcgaaagccgtgtgcataatgactttaatcaaaaccgcattattgaaaatgacccccagctcatcttgaacggtttgcagccactccaataacatttcgatcacatggtggggattcaagaagacaaggtattttttcaggctatcctcgcaaagctccctgacaataatatttgcttcgttcaatccattgctcaaggggatgcttccttttgtaatcgcctgttgaatcagcttctctccctccccttcaattaacacttctaaagatacatgcggagcattgattttagggtctttcgttccgactgtcgcaaggatttcatactctttttcgatttcttttatgctgttggccagtttaatcgatgatacggtcaatatgtgaatcggggtatcggaggccttgtttacgatcgtggttagaatgtcttccagctttttggccgttccgctgcccgtcgtgcagatggataccaatgccttctttttgccggatgccgctggctgacgctcccacagctcgataaaatccttcgtgaccgattgatagatcgcatgcaaatttaaattcaaatagttgacctttctgacagcatccagcaccattgaagtcgtaacattgctgatcgttttgatggaaatacctgtcttttcctccagcctgctttccagcattgcaagcgaccccatgtctaccagcattaaaacaccttcaccttcatcaacctgtttcattttttctgctacgcattcaagaatgtccgaaggtgaaacagaaagtggcatatcgactgctgcaatcggcgtgctccctagcagttctgtcgcaacttcaaccatcgaactcgccgtgctgtttccatgagcagccacgatgataccgactcttttgttctcctttaacgatttgatggaatggattaacatcgttaagtagatgacttctatttcaggaatagccactttaaaatattcctgaattttatctttaaaaatcatcgccacccgatattctttcacatgagtatcacgaatttcatcagtctcctgtgtattcaaaacatcaatttgctttcctcgctttaaaaatgcgtcaatatgcatactcaagaaataaataaacttgcggtcaaatgtacaatccagctcatgttcagctatttcttttaactgttttgtcatttgaatcacgtcatcttcaacgaatgtcagcaggttgtctttttgaaaagcttgatgatgaaaaaaacttctgacatgcaaatggacatcagtcaagatgtattggttaatatcctttttggataaaccttctttcataagcgttttcactttttcctcaatcaaatgatataagttaaatgaaaggtcttcgtcaatttttgttgtttcatcttctacaatcggagagataatagttgtaatattgacatattcagaaatggctttgcttctttgcatgtttttgctgctggacatccattcttgcttgatttcatcaggcagatcgcgaacagtcagttcaataacctcatttctgtcaaggttatgcaaaaatccgtgtgcgcaaactaactggacatttgatttcagctgtccgacattcccaaatttcgcagagtgaataagcgcattatagacatcgatatgcacactcagattcttcttaatccgctctgcttctttccctaataaaaacgtcgtcagatcgactctttctttaagcgatcgttcttcaagcgaaggaatatgaatggtcattgggattcttcgcaaaaacgttttcaatagtgcagaactcggattttctgtagtcgcacaaataaacaatacgttcgatgttcgtttatgttcagattctccaagcctgttataagaaccgctgtcaataaaataaaacagcatttcttgtccctcgggagggagacggtggatttcatccataaaaagaatgcccccattggcctgttcgactaaacctgccttatcctcggcagcacctgtaaatgaaccttttttgtgtccgaataattgagaaagcaataattgagggttgttgtagtagtctgcacagttaaatgtaataaatggtgcgccggccttcaatatgtcagagtaaatggcaaactggtaaattcggttcgcaaaaagggatttaccggaaccagtcggccctaggaggagcatatgcagaccgttcggcggataaaagacagctgcttttgcctgggagatcgctttcttcaaactcccttttgcccctatcataagctctaggggattcgtggaaatgtgttgatgattttgctttgaatttccggaaaacgcctgaaggtctttcacttccatcatctctgtatcccatttcttgttgaataatttttctgctatctcgactgggatgtatcttacaggaaacgttttaattttgatgacctttttggaccggacgagattgttcaattcaaagctgacattggaccgctccattttcagctgctcggcaatctcctttgctgaattcccttgtatttttaaaagatgatctaaggttgaatcatgaaaattatgcttgagctgatggtatattttatctattcttctcacgtctatcatcctttgtccttattagataagccattaacaagaatatttcgaaaatttatagtccgcgttgagattatctgctgatacacgtttaaaaaggtctctatagcagattgacaaaactggcttttatgcgtatatgtttacatgttgaatcatttgcatctcatattagtatgatagatgctcagttctcgagggccagtccccttcaaaagtaataatcagtaaacagtttatcattctcggggaatgtaatgatgtcaaaatcatcaatgacaaaaaatgaatcttatagatcatgacaaattacccaaatataaccccttaagttcgctcacaactaaaaagacgggcactctatgtgaccgccacagtattacaatttgcaaaacttcgtcatttttgcaaagttaaggaatctgtaagcttaaaaactttatctccgatatctctcgatttgatcccccctgtaggcctcaaacatagtgggtatgcaattatacaaatcgttaccgattaaaactagcctgtcagattgtccaaatgactttcctgttttactctgctattcaggtagaatcaggagtgaaaatagagccacaagacatgtaacagcacttaaaatagttttaaaatttaaaaataaaagtatctattcttttaaatgttataatatccgataaaactttacacatctttttattactggaggaaaataaaattgataggcaattctagcaaagacaattttggccagcaacagaaattgtctagaggccttaaaaacaggcatatacaattaatggcgattggaggtgcaatcggtacaggtttatttttaggttcaggtaaatccatccattttgcaggaccatccattttatttgcttacttgatcaccggcgtattttgctttttcattatgcgttcgctcggagaactgctcttatcaaatgcgggataccactcttttgttgattttgtaagggactatttaggaaacatggcagcatttatcactgggtggacctactggttctgttggatttccctcgcgatggctgatttaacggcggtcggcatttatacgcaatattggcttcccgatgtgcctcaatggctgccgggtcttcttgcgcttattatcctgctgatcatgaaccttgccaccgttaaacttttcggagaattagaattttggtttgcattgatcaaagtcattgccatactggctctgatcgtaactggcattttcctgattgcgaaaggtttttcggcagcttccggccctgccagcctcaccaacctttggagccacggcggcatgttcccaaatggatggcatgggtttatcctatcgttccaaatggtcgtcttcgctttcgtgggtattgaacttgttggactgacagcaggtgaaacagaaaatccccaaaaagtgatccctaaagccatcaatcaaatccctgtccggattttacttttttatgttggcgcacttttcgtgattatgtgtatctatccttggaatgtgttgaatccaaacgaaagcccatttgttcaggtcttctctgcagtaggcatcgttgtggctgccagtttgatcaattttgttgtattaacatcagccgcctcagctgcaaatagcgctttattcagcacaagccgaatggtctattcacttgcaaaggatcatcacgcacctggactattaaagaaattaacttcttctaacgtgccaagcaatgcgctgttcttttcatccgtcgccattctgattggcgttagtctgaattatttaatgcccgaacaagtctttacactgattacaagtgtttctacaatatgcttcatttttatttggggcatcacggtgatttgccatttgaaatatcgaaaaacaaggcagcatgaagcgaaagcaaacaaattcaaaatgcctttttacccattatccaactatttaacacttgcatttctcgcgttcattcttgtcatattggcactggcgaatgatacacgtattgctttgtttgtcaccccggtctggtttgttttattgattattttgtataaggtgcaaacccgcagaggacataagatgaaataaaaaaaagacaagggatactcactcccttgtctttttatatgtgtcaaacactaaattaaactttggtttcaaatctcattcacttcatttaagtgttaactcaaaccagttttgatgccgaaacctactaatattattccggtaattttttgaaacactttctggaacttcgagtttttcatccatttttttgcgtaatcaataatataaacaagaaacagaaaccacaacaccgctaataaggttagaattgaagctaaaatgataagctgctggtttatatttccgttcaaattgataaattggggcatgattgtaacatacactaaaacagttttaggatttagaatgttactgagtgatccttgcataaaggaagttttataataacgtttcggagaacttgccatattttttgcttgggattgcatgtcatctaacgaaaacatacttttagcaaaaaagctttttacacctaaataaattaagtatgccgctcccaaatatttgatcgttgtgaaaagaatcactgactttgcgattaccactgataatcctaaaatggcaatcaccgtccaaaaggaaagtcctgtcgccaatccgagaatgttataacggccggctttcggaccatacctaagcgtatttttcatcacaagcatcgtatctgcccccggcatgataaccatcatggcagcgatcggtatgtatgcgagtaagctgtgcattgttctctccccctttaaaaatcccctcaatcatatagtgactacaaaagtaactacttataaaagtgtatcaatgcatttggaataaatcaatatggtttgttaaaatagcgattactaaggcagcgattgctctttatattggaggatatatgaaagaaaatatgttagacattttaaaaaacctcaattttacagaatatgaatcgaaagcgtatttggcattattgcaagaatcacctttaacaggctatgccgttgccaaaaaatccggagtgccccgttctaaaatttatgaagtcttggaaagccttgtcataaggggagatgtttttgtcagtcatggaaatacacctcagtatgttccagtccccgcaaaagaactgattaaaaaccgccggctcaaagcggaagagcattttgatcaggctgagaaatattttgaaaagttcgagcagactgctaatgaccgggaaaacatctggaatatcaccggccgcagtgaaattcttgaaaaggtgaaggcttgtattttatctgccaaaaaaagaatcctcttagaaatatggaaagaggattttgaggagatagaatcagagctaaaacaggcggcagaacaaggcgttattgtcaccattattgcgtacggagacatcgtatctgatttttccaatgtttaccttcatgatatgagcagtgaaattacagaagagtatgacggacggtggcttgtctatagcggagatgattcagaagtagtagcgggcattgtctcacttggcaatgacagccgtgctgcatggacgatgcatgtaggtttagtcatgcctattactgaagtgatcattcatgatctgtacctcatggaaattctgaaaaagcatagagagctattagaagagagcttcgggaaaaatctcatccagttgcgccgtaaattttctattcactcagatttcaaaaaacattatttggaataatgtttggcatctcttaccccaaaaacaaggcttgtacaaaacaagccttgtttttttatgcataaaccccccatccccatgctgatttacttctctcttttaaaaaatgtgattctgcgcaaactatttttcagcctgccgcgtctatcctaggtaacagcctacgatatacgtatattcaaaaaggagccctttattgcaatgaagaaaaaacaaacaacaaaagcgttgcttgtcacatgcataactgatcataagcaagatttctaccggttggctttcagttatgtgaaaaatcaagatgacgcattagatattgttcaagaatcgataaaaaaagcgctgagctcagttgaaacggtcaaaaaccctgagacgataaaaagctggttttataaaattttagtacggacagccattgactttttgcgcaaacaaaaaaagataagagtgatggacgacgaaacgatagaatttttaagcaaaggaaaggaagaccattacaaggatactgatctccatgaagcgcttgacgaattgccgtaccgctataaaaccattattattttacgtttttttgaagacctcaaattagaagaaattgcggaaattacaggagaaaacacgaataccgtcaaaacgcgcctatacagagcattgaagctgatgcgcattcagttgacgaaggaggatctttcttaatggataagagattacagcaattaagagaagaatataaaaatgttcagattcctaaagaattggatatcattgttgaaaaagcccttcagcaagaaccaaaaaagaaaagaatcgtcatgtggccgacatcagcagcaatcgctgcagctattttattcactgcacttgttaatatcaacccggacgccgctcaggctatgtccaagatccctgtcatcggcaaaatcgtcaaagcgatcacctttattgaaatcaaagaggaaaaagaccaatcaagcattgatgtcaaaacacctgctttgtccgggctttctaataaagagcttgaaaacagcattaaccagaaatacttgaaagaaagccagcagctgtataaagagtttatacagtccacatccaaaaacaaaaaagggcatctcagcatctacagtgattacgagacggtcacagacacgccagatttactctctatccggcgcaatattgaaacaacacaagcatcttcctacacacaaagccgttatattacaattgacaaaaagaatgatattttacttacattaaaaagcttattcaaagatgagcgctatatcaaagtcatcagtcaaaacatcaaagaacaaatgaaacagcaaatgaaggaagatccaaataaaatatattggctcactgacgaagatgcagaaccgttcaaaacgattcttcctgatcagacgttttacattactgaagaccataaacttgtgatctcatttgacgaatatgaagtcgcccccggctatatgggcgttacagagtttacaattccaacccgtgtcatttcaaacttgctcgtgggagaacgttatattcgataaaataaaaacatccatctaagattatggatgttttctctcttctctattcgaggtcgtaacctcgctaccaaaaacaacgagaatatttgcatactattggaggaatacccatgtatcacaagacacagcatcatcgatacattcctggacttgatggccttcgggctttcgccgtcctgtcagttatcacttatcacctaaatttcaattgggctaacggtggttttatcggagttgatatcttttttgttttatcggatatttgattacatctattctattaccggcatatggaaatgatatcaatcttgattttcgggatttttgggtgcgccgcattcggcggcttatgccagcggcttaccttatgatcttttccactgttgtgtgggtcgtattgtttgatcgagaactattacacactgtacgtggagatgcgatctcttctctcttttatatgagcaattggtggtttatttttcacaagctatcatattttgatagtttcggttccccatcacctctaaaaaacctttggtctctggcgattgaagaacaattttatatcatatggccgatgttcttagttgttggaatgtacataatgaaaagccacgccagattggctgcggtgatatcattgcttgcgctttgttcagccgtgatgatgagcgtactgtatgaacctggcggagatccgagccgcgtttactatggcacagacactcgttcgtttgaacttctcatcggatgtgccttggctttggtatggccgatgaaaaggctgtcttccaacaggctgccaagcaaactgaagcacactttgcacgccactgaattttcggcattttgtattttagtgttatgtgtctatttctcagatgaatacgagccttttctttacagaggcggaatgctattcattagcgtgactgccgcaatccttattgcatgtgtttgccatccgagcagctttttaggcaatctgctttcatggaggccgcttcggtggcttggaacgaggtcttacggaatttatctttggcactaccctgttattgtgttaagcacgccagttcaagaaatcggaaaccctgttttttggcatatcgtgctaaaggtcattgtgacatgtatacttgccgagctttcctatcattttattgagaagccgatacggacacagggatttaggtcatttttccgccgtgtttttatacatagaatcatagaatggaaaacgacatctgtcatcagcaaactgtcaattggtttcgtcattttcgctatacttatttttgcaggagggctgtctgggttagccggagagcaaaagcaccctaccaaatggacctatagctcacaagaaacaaatgctgactccagccaggcttctggggataaaaagaacgctgcagcagataaaaaacactatcctgaacaaaagacaacagaatccgatcaacgtcaaaaggaaaacaaagatagtgggcaagagactcataaaaagaaagacacgcaatctcaacagacgaaaaaaccagcagacactgcgaaagaggtgttagctataggagattccgtcatgcttgatatttcttcacacctgcgtcagtcattttcaaatgtgacgattgatggaaaggtaggaagacaaatgtctcaagctttggaactcgcaagggagtacaagtcttttaatcagccgaacaaggctgtcatcattgagcttggaaccaatggctactttacaaacagccaaatcgaacaactgcttcaatctttctcaaaagcccatatctatcttgtcaatacacgggttccccgccaatgggaaagcaaggttaatgaatctttacagcaccaggcaagcgcacatcaaaatgttacgttagttgactggcatacagaagcccttcagcatccggaatattttacccctgatggtgttcacttggttcctaaaggggcaaaagctttgactgctcttattgttcaggcgatgaaatcgtaaaaaagagatcctatacggatcacttttttactttagtttctgatcgttgattatgtcttctttcagcaaggcagcccttatgtttacatgccgtttacgtaagggtaagccaaaattgaatggagggatgataatgaaaggaaatgaagaacatgacatccaaaaagagttgaaacgatatgagctttttttcaaaaaacgatataaggttctttatacattaaacgattttatcatcggtgctatgtttctcgttggaagttttttctttttctatgaccggttaatgtcggcagggatatggctgtttgcgatcggaagtttgctactgttaatcaggccgaccattcggctgattcatgactttcattaccgtaagcatgtggaacagcaattcaagcatcaatcttcaacagatgactgatcttaaggaataagaaagaacaaaatgccaaaagcctgagttgaaaatcaaaaacaagactttcagactatttatttttgaaaataaggtaaaaagaactaaacttttgcctctgcatgccgatatgaataataaggccggcgcgatactccctataacatccttttcagtagatttcattatcgtgccggttttctcatatgcaaagcaatcccgccaatcagattggcgggattttatattttacattcctgtccaaacgtcttttacataacgtttttgatcttgcagcttttgcagccattcagctgattcttcctgacttgctcctttttcagcttcatacgccaatcgcaaagttttctctacatcaggagccatttgcgatccatcaccgcatacgtaaatatgagcccctttttcaatgagtgtcatcaatttctgcgtatcttgcttgagcaagtgctggacatatccttttggttcgttttcgacgcgcgagtagcatcggcggattgtgaccaaaccgtcctgttccgcttgatccagctcttctctgtaaaggtcgtcatggtccgggcgacggcagccgaagtataaaagtgcttcaccaagggtgcttccttccttcttcaaaaccgatcttgcctgaataaagcccctgaatggcgcaattcctgtgcccggcccgaccataatcataggcgtttcaggctcatccggcatctggaatccggactgcggggtacgaatgaaacaggctgctgcatcatctgtattcaattctgctaaataattagaggcgacaccccggtattcacctcggccgctccatgctgaggctttcacaactcctaccgtcatgctcacgatatttgcatgaactttcggtgagcttgaaatggaatagtatctcggttttagtgatggcaaaagtgctaaaaaccgttcaaacggcatttcgcaagcaggataatcctctaaaaaatcaagcatggtaagacgtcttgcaagtacctgctctttgtaaatgccatcatctaaaacgagctgttccagctctttttgatgcggcggacagactgtataagaggccagctcccgaagctgaagccttgatgccggttcctgcagctctacataggacgacaataaatccgcaactttgatcggccgatccatcggcagatgagacatatgagcgcttccgcttacttttatcacatgattggactgcaaaccgaatcggctgagaacccgctgaacaagctccctgctgttcttcggcaggattccgatatgatcgccttctttatatgttttaccagccggaatttccaattcaatatggcgggttgaacgcgtgctgtcagctgtctggagttctcgattctctaacacaatcccttcaaaggcgccatatgctttagcaaccggcgtttccgtcgcttcactgagaaaagtaatcgataatgaaggcctgtcttctttctgggctatttcgttaatgtcaaatgcgtccattgtttccttccagaagcggttttcccaagactcgcggtggctttcaaaatcatcggcggcgtcaccttccccaatctctgttaaacgcgatgccccctttgctttcatcatgtcatcaatcaggcggggaatccgctgatacgtgctggcccagctccggtttccgcagccgaataccgcataggaaacacctttcaattggccttcctcaagctctttcagccactctacaaagccggcagcattatcaggcggcgccccattataagaagccgttacaatgacgactgcccctccttcagggagcttgccgatataatcatcaagcggagccgtttcagctgtaaagcccatctggcggccttgagcagccagttcaccggctattccctcagctgtcccaagatttgaaccaaaaagaacaagtaaaggtgtgccgtgtttaggtttggtttcttttggctttgtttctgctttgatgtctgcctgttcttttctctgtacattgattgccgctgttttccgcggtttcacagtaattttaaaatcatccggcttgatcgttaatgcttctttgatttttagttcgtagccagtatggtttatcaattcaaaatgctttaatacaagaccgagaaccattgtcgcttcttgaagagcaaactgcatgccaatacaagcgcgctgtccgtttccaaacggcttatacgcatggtgagggatacttgaaggatcctcaaaccgttccggacggaaatcttccgcatccggtccccaagcgttttgatcccggtgcagttttggaattaaaacagtgactggctgccctttgctgatcggatattccccgcctagaacagtatcctccttcgcatatagagaaaaagccggagctgttggatacagtctgagggtttcatttaaaaccatccgaatgtatttgagctgctggatttgtttatattcaggcgtgtcatccgttaacacgcgatccgcttcctcctgagcttttttcagtttttccggatgtgtaagcagacaataaatcgcaaaggaaagcaaaccgcttgtcgtctcatgtccagcaattaaaaatgtgatgatttgataccttatgttttcatcatccagcgtttcacccgttactggatctttggcataaagcatgagagacaagagatccttgatgttatcatccggattcgcctttcgctccgctatcattctatcgaccagggagttcatgacttctatatccttttgaaactgcagcttcgttttcaccatcatcttatcttgcaggcccagtctttttgattgattcatcgcctcttttaaggcacggagcatactggtgataaacggatgctgtgaatcacggtaaaagctgttgaatcgatagttaaatccgcataacccaatcgtatcaagcgtcagacgtgtcatatcgtctgctacatcaatttcttcattagggtttaaccggctccatttttgaatcagctgggttgcgatatccagcatcatagaatgatagcctttcatcgctttttgactaaaactcggcagcaaaatgcggtgggctttttgccagttcggttcgtgcgtccagcttgtaaataagccatctcccccgaattcgcgcaccttttgcaagcctttgccaaggttcttgtcaaagcggctttcatcacacacttcagccacaagattgtgacccgatacaaaaacactggatactcccggaaaatcaaaacggaaaatcggccccaattcatcagctatccgccataaggattgagaaagctgttctttttcaagatgcggaagattttttaaaggtccgtatgttttgggctgaggtattgcgcttgcctgtttcattaacatctccctttcctatttttgtgatgaatgaagcttaatggcgtcccagcagcattgttccaattcagtaattaaatcagtgtccatctctatatcacctgtttgaacgagctgatatatcttgagaaacgcccctaatacaatcgcaattaacacattagagggcaggctgcgaatcacgccttccgcttttcccttattaaaatagtcatcaagcatttgagtcagattttctatcatttttttgcttgtatgatttaagtaatgagcgtcttttttggtttcaagaaaaaaaagcgcatagtcgctctctttcgtaaactgaacgagacagcaaaatacgtggtgaaagccttctctgacaggcaattctgaaacgtcttgcttcagtttttccgtaaatcgctggatgctttcttgaaacagtacgttaacgagtgtttctttgctgtcaaaataacgatagatcgttcctgtccctacatgagcacgttcagctatcataggaatagtggtagcgtcaaaacccctttccgtaaaaagtgagactgacgctttcataatcatgtcgtatttactgctggatgcggatatcatgtaatctgacaacctccgattcgtttacggaatgaatattcattccttttgttcacaaagaatgtctgccctgtctgatatcacctctttgttctttcttctgttataagtttatatgaaaaaaactttttttaatataaagtatatgcaaaaaataaaaaattaagaaaatatacccaaatcctaatacaaggatcttggatatatttcccgagaaattttttatttaacagccacaatacatagacaggaagcacgcctgataacagaaagatccctgaaatgctggtctttcagcagttgaatatacgttttctctttttcaccggtatttgtgtcaatactgatataaaaccggccgtcaatttgaagcaccctgtaaatttctcttaatgcaagcctaatatcggtgcagctttgaaccgtatgtaaagaaaagactttattaaaggtacggtcatcaaagggaatgtcctctggatagccatgaaaaacctccccgttccccatgttctttcgattcgcacgtgatatctgtcttacctttcgctttgaaggatcaatgctttttaggcttcccttttctagtttcttggttatgcttttaaagacagtgccatttccaattccaatttctaaaattctgtcatttccttgtatatctatagagtcaatcatcatatgctcaattgttttggttagcttatatttccgagaaaataatttccaaaaattcgatcgtttatagagtctattttctagcattttaaacacctgcttttggtttcctatgtttatttattatattcaaaaaataaacatcatcttcattctaaaagtgaaggaaggtaccaactagacggcaatgtattgaaaaatgtttcaatagaactaaactttttcatttttttccgcaaaaaaagcagaaaacaaaatgttttctgccctctttctaatgccaatgataagggaatacatacagcctttgctgctgcattgccatcagcctctgctgtcggaatggatttccataaccatgtttgaaggaatgcggcatggacgcataaccatggccaatcgacggcagccttttttgataatcgttcatcatgccatcacctgcctcacagtaacgttgatttattgtatgcaggcaggcattttcttgacagtcatatcgctaaacttggtccttctccattgtataatgcatcaataattccattctaagcatatgccattcccccttcagtttttttcgttgcttttagcgccagtttgttaaataaagatgctttaactgagactctttcatttcatcataaatctgctcaatctgctgttctcgttcgaattcttccaggcttttaaaccgtttttttatcgttaacgttaaaaagaataggttaatcgtcatatcgctcaccccctttcaaagtccgcatcaagcgaaataacccgcggcacaccccttctgccgcgggcaaataaaaaccgcagacaaaagaagacaccaatgcctctactgcctgcggggagttgcgtatgtccgactattccgaatttaatgcgtgcgataagcatcggttaaggaaggacacgaactcttccacaggctgaataaaccatgaacttttacatgtgtatcacgtacaggttgacgtcgttgtctcattgtcattttggttcagcctcctttgctttttttcttactttgtaagtatatccaccaaattccattttgtaaacatctttttctaaaaatggacggaaattgtgcaaatcatcgaatggatttgcccgttggtcatgacacctgcttcatttcttttctggagcggtctttcttatgatatgcaataaaataaatgagaccgacaaatacagctccgccgatgacattaccgataaaagccggaatgatgtttccgatgaactgcccccacgtgaatgagcctgcaaaaatggcagcaggaatcacaaacatgttggcgacaacgtgctgaaatccgatagccacaaaagccatgattgggaaccagatgccaaggatttttcctgctgcgtcttgggcgccgaaagaaagccacactgcaagacatacaagccagttacagccgatggcggaaatgagaaccttgccaaagctcatatcaagctttccttgggcaacggcaatcgttttttctaaataaggacctgtttcagtcaatccaaccaaatgcccgaaaaagtacgcaacaaacaatgcgccgattaagttcataattgtgacgattccccagttaatcgctaactcttttactgatatttttctcgaaaataacgccattgcaactgacatcatattgcctgtgatcagttcagcgccagcgagtacgacaaggatcaggccgactggaaatactgctgcaccaatcaaactggacaggctcccccattctttcggaagatcgccgattaccctgatatcaagcaaatacccaagcgcgataaatgcaccgcctaaaaaccccagcacgagcagtgacggcagcgggagctttatttttttcatccctgcttcaattgctgcttccgctatttcatccggttttcgaaaagccataataaaacgcctccattacttcttcttttctcacagttatgcaagaaaggcaataaaaaaggcagcactcaaataacctgtgtcaaaccaggcgtttgaatgctgcctaacttgtatgcatacccatacaacaatatcaagcagtatgaagatattgaaagagaatatatacagttcgtgcatacattccattgctttagccttctataactgtagcaacatcatatcaaatgtgacaaatttgtgtcaatgacaaatatactagctttgcagaacttctttttgctcatctatttttcggtcaaaaacaaatacagatacagcgatgttttcctcaattttaatatcagaaaacaaatggactagcttagctcccatgagttcctccattccttccggtgtttgtttggaataaaggtcttgaattaggcttgtccgggccgcatgtaccatctctcttccttcaggcgtgcgggcgataaactgctcgcttgcactcagatttccatatagtgttgaaactgccatgttttctacaaatacagtatgaattctctcaggcccttttccgaacaattctttgcgaagttttcgaataatatcattgaattcatgaatttttttagacatgctgattaccccttccgatattgccttataaaggcttttcccggttcccctcaggacatttcacttggttaaaattttcctgccatattgtattataataaatatcacattataataaaagcagtgttgatggatttgtaataggatcttgttatgagtctatcgttttataaaaatcaaggattggtctgttagtaagacttgctagtgaactattccgccatgtgtgtttacaccttcttagaattaagggcaggtgtatctctatacatggctttttttgacttcttgaaagaaagatggaggggaatatgaatatgatggacgttaagtcgatcagtgtccgtgtagacggaacagaaattcaagcacgagcaggggccacaattttagatattttaaatgaaaacggaattgagtacccgcagatttgccacgtaccagaggttgacccgattcaaacttgtgatacttgcatagtagaggcaaacggcaagctggttcgttcatgcgcgaccgttgcagaaaacgggatgtctattgatctttcaggaaatcgagtgaaagaagcgcaaaccgaagcgatggaccgccttcttgaaaatcatttgctgtattgtacagtttgcgataacaacaatggaaactgtacgctgcataatacagcggaaatgatggggatcgagcatcaaaaatacccatacacgccaaaagaagatccttcttgcgcggttgatatgtctcatcctttttaccgctatgatccaaaccaatgtattgcctgcggccagtgtgttgaggtctgtcaaaaccttcaggtaaatgaaacactctcaatcgactgggagcgcgaacgccctcgcgtcatttgggatgagggagttccgatcaatgaatcttcctgtgtcagctgcggtcagtgtgtcacagtatgtccatgtaatgcactgatggaaaaatcaatgctcgggcaggctggttttatgacaggcattaaagaggacgtcatggaaccgatgattgatctcgtgaaaaatgttgaaccggggtatggcagcatttttgccatttctgaagtcgaagcggcaatgcgtgaaacgagaacgaaaaaaacgaaaactgtatgtacgttctgcggtgtcggatgttcatttgaagtatggacaaaaggacgggatattttaaagatccagcctgtttctgatgctccggttaacgcgatttccacatgtgtcaaagggaaattcggctgggattttgtcaattctgaggagcggatcacaaagcctttaatccgtaaaaacggagcctttgtggagtcttcttgggcagaagccctcgatcttgtcgcaagcagattaggatcaattaaagagcagtacggtaaaggctctgtcgggtttatttcttcttctaaaattacgaatgaagaaaactacgtcattcaaaaactagcgcgtcaggtatttgaaacaaacaacgtcgataactgctcacgctactgccagtctcctgctacagacggattgttccgcactgtcggcatgggcggtgacgccggcacgattaaagatattgccaaagcaggcctcgtcatcattgtcggtgccaatccggcggaaggacacccagtgctcgcaacacgcgtcaaacgggcacacaagctccacggtcaaaaactgattgttgctgacctgcgtaaaaatgagatggctgagcgatctgatctgttcatcagccctaaacaaggcacagaccaagtttggctgatggctgttacgaaatatatgatcgaccaaggctggcacgatcaggcgtttattgatgagaacgtcaattactttgaagattataaagaaacccttaaaacgtatacgcttgattatgcagaacgcatcacaggcctttcaaaagaaaacatcattcaaattgctgaaatgattcgtgatgctgacggcacttgtgtcctttggggaatgggtgtcacacaaaatacaggcggttctgatacatcagcagccatttcaaacctgcttctcgctacgggcaactatcgccgtccaggtgccggcgcttatcctctgcgcggacacaataacgtgcaaggcgcatgtgatatgggaacattgcctggctggctgccgggatatcagcatattacagatgacaaggcccgcgctaaatttgaagaggcatatggtgtcgagattgatggaaagcctggtttagataatattcaaatgcttcatgccattgaagaaggaaaaatgaaagctatgtatcttgtcggtgaggatatggcactggtcgattcaaacgcgaaccatgtgcatgatattttatcaagccttgatttcttcgtggtacaggacatctttctgtcaagaacagctcaatatgctgatgtcgtcttgccggccactccttcacttgaaaaagacggaacatttaccaacacagaacgccgtgtgcagcgattgtatcaggcgcttccgacgcttggtgacgcaaaaccggactggtggattattcaagaggtggcaaaccgtttaggagcgaattggaattacagccatccaagtgacattttctctgaaatggcgagtctttctcctctgtttgccaaagcaagctatgaggtgcttgaaggctggaacagcttcctatggggcagcttcacaggtgaaagcacaccgcttctgtatgaagacggatttaatttccctgacaaaaaagcccgctttgccctttctgattggaccgagccagcggcatttccggaggaatatgaccttcatatcaataacggccggatgctggagcatttccacgaaggaaacatgacaaataaatcgaaaggcatccaagcgaaagtgccgaatgtattcgttgagatctcacctgagcttgcacaagagcgaggtgtttgtgacggttcgcttgtacggctcgtttctccgttcggagcagtcaaattgaacgcgctgatcacagaccgggtacggaaaaatgaactctatctgccaatgaactcgacagacaaggagtcagcgattaacttcttgacgggccctgcagctgataaacggacgaacacgcctgcttataaacagacaaaggtccgcatggaagtgcttggcggctgtgaaacagcgccgcttccaaaaacaaatccgcgcaacaaaaaacggcatccgcaaaacggagtcgaagcagaaagaaaatggaaccgccctggctatgtacatctgactgattaaacgataggaggaaaacgaatggccactccgattacgacgatcaaaaaagaaacaaaaacagctgagcaaatgaagcttgaaaaaatagaagaactgaaagagctgctggcggaaaatgaggacgccgtctctaaaacgatgacgttaatgaatgaactcaatgatcttggaatttttgatgcggcaacaagcatgctcagagcgaaggaagacattgccaagattgcgcttggccaagtttcccgcgagcctgtcaccaacctcatcaacacgatgatggccgccggaggcgcattgacaaaagccgatcctgagtttacagcaaagcttttagaaagcgtaatggctgggactgaacaggcacaaagctttttaaaagaagacaagaaagtcgggattctcgacctgttaaaagcaatgaacgatcctgatatcaacagagccgtcggcttcggccttcagtttttaaaaggcatgggaaaagaacttcgagaacaataacagaaaaacagccatcgctgatgatggctgtttttttattcgtcggcttcttccaaacgcttcttgtaaataagtgaacggtcagcgcaaaagaaggcaccggctaaaaatacgcaatccgctaaaaacatcgtcgatttctggcctaatgttaaaccttgatcagggagaactgcgcctatatataaaaaagtgctgactgcaagcaatgtaaaagcaaaatgcttgtagtcttcttttaaagatttcattctatttttgttcaaaagaatcacctgccagattcatagtatacgactattataatataatccggcggcttacagagaaagtaattctatccatttgttatatattttcaagcgcttggccgatatcttccaacaagtcttccgcatcttcaattcctacagaaattctgatcaagccgtccgtaatgccgagctcaagccggcgttctctcggaatagaggcatgtgtcattcttgcaggaacagaaattaagctttcaaccgcccccaggctttcagcaatggtaaacagtttcagatttcctaaaaacgcatcaacccgttcttcactgccaatatcaaaggagatcatgccgccgaagcccgctccttgcgtttttgcaagctcatgtccgggatgatttgaagaaccagggtaatataacgtttggacagcagggtgattctcaagaaagcttgcgattttccgcgcattttgatcgatcgcttccattctgagtcccaacgttttgattcctctcattaacagccaggaatcttgagggccgagcacgccgcctgtggagttttgcacaaaatgcagctcttctccaagctctttcgaagctgtcacaactaaacctccgacgacatcactgtgtccgccaagatattttgtcgcactgtgcagtacgatatcagcgcctaaagtaagcggctgttgaaaataaggagtattaaaggtattgtctacgataagcagaacacccgctttttttgcgatatcagccatgagcgtcaggtcggtgattttgagcaacgggtttgtcggtgtttcaatataaattgcttttgtattagggcgaatcgctttttcaacttcttccctgctgctcgtatcaacaaatgttgattcaatgccaagacggttaagcacctttgtcatcacgcgatatgttccgccgtacacatcatcagtcaacacgacatgatctccgctgttaaacagcatcataaccgctgtaatggcagccattcctgagctgaacgcatagcctgcttccccgctttccagttctgtcacaagtgcttcgagagcggttcgagtcggattggccgttcttgaatactcgtagcctgtatgctgccctgctttcggctgcttgtacgtgcttacttgataaatcggcacggaaactgcgcctgttttctcatcacctgtgattccgccatgtatcatcaatgtttttttcttcatatcagatgcctccttcgtatatttgtttgctgatatatcgatcgctgctgtcaggaaatactgtgacaatgttagttccagcggatgcttttttcgcttcctccaatgccgcataaagcgctgcacctgaagagcttccgatcagcaggccttctttttctgccgcttctttcacaagtctaaacgcattctcatctgttacggtgtagatctcgtcaaaatggctcttatccatataatcggggataaactccatgccgatgccctctgttttatgagcgtggggctctcctccgtttaaaatcgagcccaccggttcaacaatcaccgttttgactgctggatttttttcttttaagaaggaagctgtccctgcgaatgtgcctcctgatcctgcccctgcgacaaatgtatgaatattcccatcaagcgcttcccacatttcaggcccaagcgtcttatagtaagtcgatggatttactcggtttttaaattgcaaaacgcaataagaattttcaatttcagtctccagctgaatggctttttgaatggcgccctgcattccgtcttgacgcggtgtatgaatgattgatgcgccaagcgcttgcataatttgctgtttctctctgctgaaatgttcagggacacagaaaatcgctttcagcccatattttctggcactcagcgcaaggccgatccctgtattgcctgccgtagcttctataatcactccgccgggtttcactttgcctgaatcgagcgcgtcacgaatcagcatatctcccagtctgtctttgatgcttccccctggattcatcatttcaagcttggcatacaccgccactccttctggaacatcaaagttcttcaagcggagaagcggtgtattcccaatcagctcggtaatgtccgtaatcactgtcatatatgtcctcctccttattagagggtgtttttagaaaaaacggaggagaacattctccccgttttaatgaattcgtttgatcacctttaacacaagctctgttgaatggacagccgcctgctctaaaaattggtcaaatgaaacatgtgattcttttcctgcaatatcagataacgctctgatgacgacaaacggcgttttaaattgatggcacacttgagccactgccgcagcctccatttcaaccgcatacaaatcagaaaatctcgtacgcacctcttcaacccgcttcggatcgttcatgaaagaatcgcctgttgcaatcgttccttttgcaacctgaatgccgtcgagttcagataccgcttcttcagtgatgctgatcagcttttcatccgccgcataagcagccggaagacccggcacttggccgtattcatagtcaaaagccgttacgtctacatcatggtggcgaacgtcagtggaaatgacgacatctcctacattcaatgtatgatgaaatccgccggctgagcctgtgttaataacataatcaggcttgtaacggtcaagcagaagcgtcgtgctgatagcagcatttacttttccaattcctgattttaaaagaaccacttcagttccttcatattcgcctgttgtaaattcacagtgtgcgatcgtttctgtttttgcattttcaagtttgtttcttaagatggtaacttcctcttccattgctccgatgactgctagtctcatctattcacattcccttcactttaccgtttgatcgcctccattatccacacgaagtcgttttgctgagtgaatcggactgcaaaaccttcagctgtaaacatttctttcaacgcatccaatgtaggataatgctctgtctctaaatcatttgcaagctgataaaagccttgagaacgggctttatcgatagcctgttgatacgcttgcgcatcttcaaagacggtatcggcaaacactattttatcatgcaagtgaaggtatttgccatattgctttatggcagcccgcttttcttcgtcagtcaaatgatgaaaagcatatgaactgacaattgtatcagcctgaaatggcggctcagggaatgtcaggaagtctccatcaacgatttccgacctgcctgaaagcttgtcagaagccagtttacgcattgctggagaaggttcgattccaaatacagttttgcctgcatcgagcagcttagccgtcaaattccctgtccccgggccaaattctaacacatgcgttccagatttgctgacgatggcatcaaggatatgatcatagcctctgaacgcttctttatactgaatatctaaaccttgtactgtttgatcataagttgctgcccaatcttcaaagagagggataaattcacgtcccatatttgtcacactccatatttaataattcctataagcatactatgaattaatgatggaacagttcctataataccacatcttctgaaaagcaggtactaaaacactttgtgtattttatgccatctcatattgcgcattgaccgcaaaaaagcttatacttcaaatgacttgtgaaagctggagggtcaagatatgaattttcaattagatctgattaaagacaaagtggaattttttgaagcggcttcattgcaggagcttgaaaagaaaatcaatacacaaattgaaaacaataaagccatcatgctccgggtgaaatctgtttcacaccaaactgctgtggcagaaggaagaatattgtacagcgcggtggttcatttcgcagctgaagcctaaaacaaaagcagccggttctaacccggctgcttttgtttattttagcttttctacttttgtcggcttccagccttttttatcaacccatgtaatcgtgacttgatatttattcccagtcgccttgtccaaaatcttgcctttagcatcctgagggctgccgttatttccaagccagagcaccgtcatgttatctgttgagacaccagttgcgtatgaaatggctttcagcatctcagcccagtcttgtgagcttgaatcataagtagcggcatgctcgccagcctgctcagttccgactgctttccagtcaggattttcatacgttttttccacatcgctcgatgagccgccttctgttacttttgcatctttaagcccgtcaccggctgaatctgagcttgaatctgaatcagagtcatcttttttagaagaagaatcatcttttttggaatcagagtcagaagacttctcagaatccttttcgctgtcagatgtatctttcttgctgtcttttatatcctcatccgatttcttttcagtctttcctgaagccggagattcctgtttttgcgccgtttcagaatccttgctgacatctttgctagaaggactgttaatgaagagattcgctgctactacgacaattagtatggatacgattgcgattaaaatgttaagcactaaattggcttttctgcgtttatcacgattttcataacgagattgattattgctcaataattctgcactcctttatccctcttggctcagcatatattttaacatgtgctgagaagttgttctatttctgattgatttcaatttcgtgtacttttttaacaatatcataaaacaccgaatttgtcagagccttatctcccggtgtatccatgtgtaaaacaaccagagcgtatttcggcttatccgcgggaaaatatccggcaaaccatttttcatagagcgtttccctctcttttgaaagcttgcctgtttgggctgtgcccgacttccctgctacagtatacggaagatcttgaaaccttctgcccgttccggaaggagattctaccacccgccgcagtattttttgaagctgctgtgacgtatatttgtctatcgtttcccctttgagcttctgatctttaaacgtaacgagcgttgtgccgttcttatactcaatttgttcggcaattttcacctgccgtttttctccgccgcgggcgattgtcgccatcatattggctacctccagcggcgttacctttacgtttttctgcccgattgctgtttgcgcaatggcttttttgactgatttgtctttttcatccccccaaatcacgccgcttttttcgttatacagctggcggaaatcggtttcgtggtacagttttccctcccagcctgcccgatcagtgagagccagcttctcggacatatcttcaataaccgagctgtcttttttcattaattgttctgcaagactcgtaaatgtgtaattacagctttgggcaaaactttcatcaaaagacaaggttcctttgtcgtcccccggttccccgtacaggtttaaattgcaattaaaggtttgactaggcttcaccatattattttcgattgcagctgcggcaatgactgttttaaaaactgatccgggatagattggcgtcagcatataattttgaagtgtgttttgccgggacacatctgcatctggtttgcttacaatccccagaacactgctattttcgatgtccagcagcacagctcctccctttttcagcccctgttcatccaatacctcctccatcgctttttgaatgctttgatcgatcgttgttttgacctggagcggataaaatgtattggcttcagctgtatatttgacgtccatgccaaacaaagggtttccttttccgtccacatgatataaaagctttgtgtcttgttccggaagcaaaaactcgtcaaatgtccgttctaaaccggttgttccgatttctgttgtaatcggaaggctctccttgtcaggatatttcttgcgaagcagcgccggatcttggttcgtgctccctatcgtatgtgaagcaaggctgggcttgtcttcattctccatatatacgccgtaaatgccgggatatttcaaagaattgatttttgtgatagattgttttgaaagtgttttgattttcttttgctgcaaaatgaccggtttttttgcctgacctagtgtctggcgcaaatcatcttcagacatgccgaggatgtccgcaacttttttgatcggccaatcctgcgtcagcagaaaagggaacaaaacaaccgcaggctcgctttgtcctgtcagcgcccgcccgtttcgatctaaaaaagagcctcttccatctgaaatgagcacttcctccgtccgctgtttcacactttcttgaatcaaattaattttctttttagaaaatgattctgtgaaaaacagctggatttctgcaagtctcagcagaagcagaaaaaatacaatcaaaaaagcgatgactgccagcttcattcgtttcgatatcttcataaaaaaaacacctcacccacattgtggacgaggtgtttcgctgctaaacagatattatgaaattttcacaattttcacgagcatttctccgcccggtgtttgtactgtgacttcttcatctacttttttgcccaagaggctttttgcgatcggtgaatcgtttgagattttcccttcaaacgggtcagcttccgcgcttccgacgatcgtatatgattcttcatcaccgtcaggcagttcgacgaaagtgacggttttacccaaaccgacaacgttagagccgccgtcatcttcaatgattttcgcattgcgaatcatattttcaagagtcgtcacgcggccctctacaaatgcctgctcttctttcgctgaatcgtattcagagttctcggaaaggtctccgaagcttctcgcaattttgattcgctctactacttcttttcgtttaaccgttttcaaatattctaattcttgttcaagtttttgttttccttctgcagtcataggaaaaactttctcttgtgccatgtcccttcactccttctggttgtccctcaacatcttcgattatgtatgagagcataaactaaaaaatacaagaatgagaacacagggcagtcctcgttcttctctcccatataggtactgtttatcttaaactgaatcgtgtcgttctgcaaatatttcgcgtttataaacagggaaagaagggaattcgcacattcccttcctgcctatacataatatggtcagagttatttatgtctatgctatggtattacaaaatcgcgttttgttcaagaatggtttgaatttttgtgaccatcagatcaattgcgacgtgattctgaccgccttccgggataataatatcagcgtatcgtttcgtcggctcgacgaattggttatgcatcggacggaccactgacacatattgttcaatgacagaatcaatagagcgtccgcgctcattaatatctctcataatccgtctgatgatacgcaagtcagcgtccgtatcaacataaagcttgatatccatcagatcacgaagccttttgtcttcaagaacaagaatgccttcaaggataataacatcctttggctctacgtgaaccgtttcttctgaacgtgtgtgaagcttatagtcataaatcggcttttcaatcgggcggtaattcaatagatcttgaatatgctcgattaaatagtcattatcaaacgcaagcggatgatcatagtttgtgttcagcctttcttcaaacggaagatggctttggtctttataataaaggtcctgctggatcattaaaattgagtgtcctttaaactgttcataaatggaccgtgtgacactcgtttttcctgaaccggaacctcctgcgattccaatgactactggattcttacccatgggctgttacttcccctttctcatcatgttgctcggataaatctttttgtctagtttgaatttgacaatttgcaggggatggcgggcagcatctagctcatttccgtcttcgtcccaaatggtttcaatcgtatgtgtaaagttttcgatttctggaccgaaaaattccacttcgtcgccttttttgaagaaattgcgctgctgaagcgtgaccatttgtgtatcttcatcataattcagcactaagccgacaaaatcatatgtcgttttcttggcgtgttcgccgaacatttgctcttcatagcctggcgttccttcaaagaaagctgtcgcagtgtccctgttggcgcacttatcaagctcttcaagccattctttttgaatcacaaagttttctggatcagcgcaataagcatcgattactttgcggtatacgctgacaacagttgctacatagtgaatggatttcatgcggccttcaatctttaagctgtcgatccccatttcaatcatttttggaatggattcaatcagcttcaaatctttcgggctcatcgcaaatggtgcatcttcttcaccatacaaagcaacggcgttggcaccgtctgtttggtagagatcataatcccagcggcatgactggcagcagcctccgcggttggaatcccgcgctgtcatgtgattgctcagcacgcagcggccggaatatgcaatacacattgcgccatgaatgaaggattcgatttcgatatctaccttttctttcatttctctgatttcaagagcgctagtttcacgtgccagcacgacgcggtcgagaccttcttccttccagaactggacagccttccagtttgaaagagactgctgtgtgctcaagtgaacctcaacattcggcgccactctgcggcatgtttcaataataagcggatctgccacaataataccggcaacgttggcgtctccaagcgcttttaaatagtcttcaagcccgtccatgttttcattatgagcgaaaatattcgttgttacgtagatcttcgcgccatatttctttgcgaattcaacgccttctgcaatttcttcgatcgtaaagttatcggcattcgagcgaagcccgtattcctgtcccccgataaagaccgcgtccgctccgtaatgaacagcgattttcagcttttcaagattacccgcaggtgcgagaagctccggctttttcgtaatcacacgctttccattaacgattgtggatattttatcatttacggcagtcatagcttaacctccttttgattaataaaccgtttccttgaagaagaatccggtatcaatttttctgtttactggctggatgctttcaatgcgttcgatccagtcttcttttttcgcttcgtattcgtcacggttttccacgcacaaatcaattgcttctctgtacattttggtgacttctattaggtattcaggcattttcaaaacaccatcgattttgaaagaatcaattccggcatctatcaattcctcgagctcatcaatgatgcacacatcgttcgggctcatgatgtgagtgccgttttcatcttcgaaaatcggatatttattatcgcgttctttatcgtgtaaaaacatgcctgattcttttttctttctttcaatgtccatgactttgccctgatattcaaaatagtttccaatcaaagaacgcttcgattggaacatgcacgtcattccatgcacctggatttcaatttcgacttcagcattttctttaatctcaacaatgctgtccatgtttaattctctggcaagcacagaacgcgccgcacccttgcgtccccagtagttgcatgtataatagttggtgcctgtcgtttctgtgctccaatgaagcttcagatcaggcgcagattcacgggcagccatcagcacggcaggatcgccgaataccgctgcatcgacaccggcttctgctaagaaagccagatattcgccaagctcacccactttatcattatggaaaattgcatttacagcaacgtatacttttgccccttctttgtgagcaatctctacggcttttgttacatcttcacgagaaaattctccggctaatctcaagccgtatctctgttccccaactaaaaacgcagttgccccagcctgtatgagcggcaaaatgtccgctgtactcgtcggcgtcactaagagctctggttttttcatgacgttcacctcttctttttactaatcgcaagtccgtccccgacaggaataatcgcagtttgataatccggatgattcatcagccaatgattatattcatcaattttggctacaagcctgcgccttctcttcggttctattttgctgtaatcctctgccaccagacctttaaacagcacgttgtctgttataatcaccccgtccggtgaaagcatcggttcatataaatgaaaaaagttttgatactgaccttttgcagcgtcaataaaaatgacatcgtaaggcgcggttacatgaacggcgtcggctaattcaagcgcatctccgtaaaaaacatgaatccggtcatcaagctgaaattccttgatattgtttaccgcttcttcatgccgtttctcattgcgttcaattgtatatatttcagcagacggcagttccagagccattcgaatggctgaataaccaatggccgttccgatttctagtatttttttcggctgtttcacagacaaaatttgaagcagcacctccatgcccgctttttccataatcgggacatgatgttcttctgcatatgcttcaagtctcttcacgttatccggccgaggctttaataatgcttctatatagtcatttatttgttcataccggtcagtcactacaaacagcctcccgttctaaaaaggagtgccccagtcttatgcgcaggacactctctgaatacatcatgatacatcggtaaacaacccgatatattttatcataaaaccttgcggaaagcgaacaaaaggagagctttttgctctccttttatttctcattttttgaggaaatgtatttttcttttgctttattatgctcttttagcgtttttgtaaatacgacctcaccatttgatttggccaagaaatacagatagtccgttttatccggatgcagcgctgcttcccatgatgacatgccggcattggcaatcggccctggcgtcagccctgtgtttttatacgtattgtatggtgaatcgatttccagatccttataaagaacccgatctttatgcttgcctgccgcgtacaggacggtcggatctgtttggagcggcattttctttttcaggcggttataaaagacgctcgcaattttatggcggtcggctttttcagtcgcttcttcttctatcaaagaagccattgtcagcagcttatgcacagaaactttgtttttcttcatttctgatttatatgtttccacataagaatttgtctgcttaatcattgccttgataatgtcttcaagtgatgtgtccggatcgttaaaagggtatgtagccgggaataggtacccttcaagcgggtgcttaatgtttttattgaaaacatcatttgtcacagtgtccgggaattctttcttcagctgattgataaatgtttcatcgtccagcttcgctatgacttgttttttagagtattttgtttcatcagcaatagcagccgcgatttgggtcagctgtgctccctcagtcactgtgatttgaaaagcgtaacctgtagccccgcttgtcagcttctgaataatggcatctaaatccatacctttattcagatggtagaatccggcctgaaacccggaagcacctttatatttcacatagtactgaaacgccttctcgctttttatgacatcatttttctttaatatcgatgcgatggctgaaacagacgaaccgctcggaatgttaatattaactgtcgttttactgtctttttcaacaggttcaagcaatgatttcccatataaaaatgccccgccaatgatgagaaacagcacaacaatggaagacagtatgattctttttttattaaaaaacgattttttttgctgattgatatacattaggtctcctcccatcagctcttatactacatgattcattgtatttcggcaatttattacaaaaagaggcctgcataaagcagaaaaaagccggagcagtatagctccggctttggtttggcgcgatgttttactcttcgtcttcgtccgctaagaatgtgtttagtgtttcttcgatcatatcccattcttcgtcagtttcaatcgggaatagctcaccgttttcaccgtcttcgtttggcgtgaagctggaagcaagaatttctacttcttcgtcatcttttgattcgattggatagtacaagacataagatttgccaaactcttcattttcaaatgtaaacagcacttcacaaagctgttcatttccttgatcgtcaacaattgtaatatttttttcgccgtgttccattttcttcacctctggctttaatttaagctgtcaagatatccttgtaaaatcataacagccgccattttatcaatgactttttttcgtttttgcctgctgacgtcagctgcaatcagcattttttcagccgccattgtggtaagacgctcgtcccacagcacaacaggaacattgtacgttgtttcaagcactttcgcaaatgtttggctggcttcgcctctcgggccgactgttccgttcatgttcttaggaaagccgagcacgattttatctatagtatagtcctttatcagttcagataaacgggataaaccataatcgccttctgcttcatttatctttatggtctcaatgccttgagcagtccagcccatttcatcgctcagagctacaccgagtgttttggttcctaaatcgagtcctaatattctcattctttatttacgcctctttatgctgttctaaataagactttaccaattcctcgattaattcgtctctttcaagtttgcgaattaaattgcgagcgtcacgatgcctaggaatataagcgggatcacctgacagcaagtatccgacaatctggttgattggattgtagcccttttcctgaagcgcgtcatacactgtaatcagcacctcatttacgttagtctcagcagaatcatcggagaaattaaatttcatcgttttatcaaacgagctcaccgttttgcacctctttcccaaattcgcaggcaaagttcagcctggggtcctaatcttaccatcattctacactacatgggcgaattataaaacggatttcacccaatcttctacagaagccaaagcttcttctaatttttccggctgtttaccgcctgcctgcgccatgtccggacggcctccgccgcctccgccgcaaacttccgcagcttgtttaaccagcatgccggcgtgaagtcctttctcaatgaggtcctttgtgactccggcagagatattaactttatcgttttgtaccgcaccaagcacgatcaccgcagagccaagctttgctttgagttcatcgaccatagtgcggagatgattcatgtcttttgcatttacttttgccgcaagcacgtttacgccgtcaacttcttttactttcgacaggattgctcctgcttccacgttgcctagttttgcaagaagagattcattttctctttgtgcatccttcagttcagcctgcagagccgcgacccgtttcggcacttctttgatatttgttttcagctcgtcagcggtctgcttcaatacagaaatctggctgttcatttcgacgtaagcgccttgtcccgttacagcttcaatccgtcttgtgcctgctccgattccggattcagaaacgattttaaacaagccgatttctgctgtatttctgacgtggcagccgccgcacagctctaagctgtaatctccaacttgaacgacacggacaatatcgccatatttttcgccgaacagtgccatcgcacccatttcttttgcttcagcgatcggtttcaaatcaatgctgaccgggatgctcgcccagatcttttcgtttacgattctttcaatttgttcgagctcttcttttgtcacttggccaaagtgcgagaagtcaaaacgaaggcggttttccgttacaagagagcccgcctgattgacatgagttccaagaacatcttttagagcctgatgcaataaatgcgttgccgtgtggtttttaatgacgccgcttctcatatggtcttcaacttcagccgtaacatgcaggcctttttgaacagtaccgctctccacaacaccttcatgcacatgctggccgttcggcgctttttgaacatctttaattcttacaactgcctgctcgcttcggagatagcctttgtcgccgatttggccgccgctttctgcatagaacggtgtttcatcaagaatgatttgaacgctttctccttcatgagcctcttcgattaattggccgtcctgaagaagcacaatgatattggcatcagctttggtttgagagtagccgacaaatgtgctttcaactgtcacgtcgcgcagtgcgccgccctgcacctgcatgctgccgacatcctggcgggcgtttcttgcccgttcacgctgctggttcatttcctcctcaaagccctcatggtcaaccgtcatgttctcgtcttctgcgtattcttcagtcaattcaaccgggaatccatacgtatcatacagtttaaacacatcagcacctgagataacgctgctgcccttgtctttttcttttttgatcatttctgacaggatcgcaagcccttcattaagggtctcatggaagcgttcttcctcggttttaatgacttttgcgatgaaatccgctttctctttcacttcaggatagaaatcagccatgatttctgcgacaaccggcactaaatcaaacatgaacggacgatggatgttgatcgttttggcataacgcacggcacggcgtaataagcgtcttaatacatagccgcggccttcatttgacggcagcgcaccgtcactgacagcaaaggcaaccgttctgatatggtcagcaatcactttaaacgcagtgtctttcacattgtctttgccatatgtttcaccagaaatcgattctgttgctttaatgatcggaacaaacaaatcggtgtcaaagtttgtcggaacattctggatgacagacaccattctttcaagacccatgcctgtatcaatatttttctttggaagcggtgtgtacgtgccgtcagggttatggttgaactctgagaacacaaggttccatacttccaggtaacggtcgttttccccgcctgggtaaagctccggatcttctggatcattaccgtatgcttcaccgcggtcgtaaaagatttccgtattcggtccgctcggcccttcaccgatatcccagaagttcccttccagacggataattctttcttcaggaataccgatttttttcgcccaaaactcatatgcctcttcatcttcaggatgaaccgtaacagagagaagctctttgtcgaagccaatccacttgtcgctcgttaaaaactcccaagcccatgtaatggcttcttctttgaaataatcgccgatggaaaagtttccgagcatttcaaagaaagtgtgatggcgcgcagttttacctacattttctatatcgtttgttctgatcgctttttgagcgtttacgattcttggattttccggcacgacacggccgtcaaaatattttttcagcgtcgcaacaccgctgttgatccaaagcagtgaaggatcctcatgaggcactaatgacgcgcttggctctaccgcatgtcctttttctttaaagaaatccaaaaacatttgacgcacttccgcagaagttaagtgtttcattgtatttcctcctctataaaaatcgaaattctcttcagtgacagcaaaaaagccctccccctatgcaaaccaacgtttacacagggacgagagctgtctcgcggtaccaccctgattacgggcattcatgcgcccgtcacctttaaccctgtaacgcaggataagcggcagtgattaactgcactcaggattagcttcctccgatcttctgataaagctcctttcagcttatggagcttctctctttaacagggcttcggcgtactcagatccgtcactcgagattcgtatgtattctacgagaaattatagacaagcggcacgccgatgtcaatgctccgtcctcatccgcaaaaaatggatcatcattacttttaaaacagccgtcgcaggaacagccagaatcatcccgacgatacccgcaagctcccctccggcaaggagtgcaagcatgataacgaccggatgcattttaaggcttctgccgacaatgaacggactgaggatatttccttccataaactgcagaataaacaccgtaatcaccacaacaagaaccgccttgactgagatcgtcatcgcaattaacaacgcaggaacagctccgatgaaagggccaaaatacgggatgacattcgttaccccagagataaggccaagtatcagcggatacggaagcccaaatacccagaacgaaatgcctgcaatcacgccaagaatcaagcagaccaaaagctggccgcggatataatcgccaagcgaatcatccacatcccgcaaaaaggcgctgccccgctttctccacgacttcggagtcaagtaccatactgtctttttcattaactcaatgtccttcaccatataaaacacgagaaaagggattgttgcagcaattaagaagtaatcaagcacattgcggatcccgctgatcgcaccctcgatcgttcccgcaaaaaacgcctccgtctggcggatcattttatctatacggtgatgcataccatcaggccagtcatccgtatggttatgcacatgaagaagaagcccgttatacgtttcggcaaacatgggtatattttctgacaaatccgtcagctgcacgattaaaacaggcacccctttatacaacgcccagccaatcccgccaaaaaaaagaacataaatgaccaagatgctcaaagtcctaggcaatcctttgccatgcagccattctgtgaccggaagcaataaataagatataaaaatagaaatgatcaagggaataaagatcgtttttatgacgagccaaaagggtgaccataacatatcaagcataaaaaagacatagactgttaacagaaccagcaaacaaatagccacccacaacaaaagctgcaccggtttttggagcatctgctttcacctcacctatatcttttgaggtttacaaggaattattctttatgtttctttagtcagtcagaagtcatggacattttttcacttttaattttcagaaaagtttgatcatttactttttggtcaaattttctgataggaggattgcgatgatcacatttcaaaatgtaaacaagcattacggagattttcacgtgttaaaacaaattaatcttcaaatcgaaaaaggtgaagtcgttgttatcatcggcccatccggttccggtaaaagcacattgctcagatgcatcaacagacttgagtcgatcaatgagggagtgcttacagtaaacggcaccgccattaacgacagaaaaactgatatcaatcaagtgcggcaaaatatcgggatggtgtttcagcactttcatttatatccgcataaaacagtgctgcagaacatcatgctggctccggtaaaagtgcttagacaatcacctgaacaagcaaaggaaacggcgcggtactatcttgaaaaagtcggcatcccagacaaggctgacgcctatccttcccagctttccggcgggcagcagcagcgtgttgccatcgcaagaggactggcgatgaagccggaggtcatgctgtttgacgagccgacatcagcacttgatcctgaaatgatcggtgaggtgctagatgtcatgaaaacactcgccaaagaaggcatgacaatggttgtcgtgacacacgaaatggggtttgccaaagaagttgccgaccggattgtcttcattgacgaaggaaaaattttagaagaagcagtgccggctgaattttacgcgaacccgaaggaagaacgggcccgcttattcttaagccgtattttaaatcattaaaacagaaatggggagcttgtatgaaaaagattttttctttagcattgatttctttattcgctgtcatcttgcttgccgcttgcggcagcaagggatcaaacggagaagcctcaaaggagagcaaaaaagatacgctagccgccattaaagacaatgacaaaattgtcttcggcgtaaaaacggacactcgactgttcggtcttaaaaatccaagctcaggtgagattgagggttttgatattgatattgctaaacaaatcgctaaagacattttaggtgatgagaaaaaagctcaatttaaagaggtcacctcaaaaacaaggattcctatgctgcaaaacggggatatcgacgccattgtcgccacaatgacgatcactgaagaacgaaaaaaggaagttgacttttctgatgtctatttcgaggccgggcaatcgcttctcgtgaaaaaaggcagcaaaatcaagagtgtcgagaatcttggcaaaggctcaaaagttcttgcagtaaaaggctccacctcctctcaaaacattcgtgaaaaggcgcctgaagcatctgttttagaatttgaaaactacgcagaagcctttacagcccttaaatcggggcaaggcgatgccctcaccacagataatgcgattttatatggaatggctgatgaaaataaaaattatcaattaacaggaaagccttttacagatgagccttacgggatcgccgtgaaaaaagggcaatctgctctcgcgaaagaaatcaacgcttcacttaaaaagatgaagtcggatggcagatacgatgaaatttataaaaaatggatcaaagaagacccagctgaataacaaccatcccgggatgagcaggcgatgctcatcccaatttgataaggagtgaataggcagatgaatgtgtcaattcttttcgataacttcagcatgtatatggacggtttttaccataccttgctcgcaagtgttatcgcgctggccggcagttttgtcctcggcgttgctgtagcggttatgagaataacagtctttaagccgctgcaatggctcgggaccgcatatgtagaattcatccgcaacatccctcttcttttaattacctttgttttctatttcggacttccaaacgcaggcctgaggcttgacggttttcaagcgggaacggttgctctcaccatttatacctctgcgtttatcgctgaagccatcagagcaggcatccagtctgtttcaaaagggcagatggaagcggcacgctcgtcaggctttacctacagccaagccatgctccatatcattttgccgcaggcaatcaaaatcgtcattccgcctttaggcaatcaatttttaaacttagtcaaaaactcttcgattcttggggttgtggccggattggatcttatgtaccaagccgatttagtttcgtcgagcacactcgttgtatttgatgtttatatttttgtggcgcttttttacttagtgctgacgattccgcttagcatcggtgttaactatctggaaaaacggctggaaaaaagctattgataaggagtgagttacattggatttcatcggtgcttattcacaggagcatttagcgtttttatgggatggctttctcgtcaccttgtacgttgctttcatctccatcattctgagctttttcttcggtttaatcgcaggcaccctgcgttatgcgaaagttcccgttctttctcaattgattgcagttctcgttgaaacgatcagaaacctccccttgctgttaattattttctttacgttttttgcccttccggaaattgggattaagcttgaaattacagctgctgcaattacagcactaacgatttttgaatccgctatgctatctgaaattatccgaagcggactgaaatcaattgacaaaggacaaattgaagcggcgcgctcctccgggctgagctatacacagaccctgttctttatcgttatgccgcaagcgcttcgccgcatggttccgcccatcgtaagccagtttatttctttattaaaagatacatcgctcgctgttgtgatcgccctgcctgaactgattcacaacgcgcaaattattaacggccaaagcgctgacggcagttattttttcccgatctttttacttgcggcccttatgtatttcgcagtcaactacagcctttcactcgcagcaagacgcctcgaggtccggcaaacatagaaaaggatactctttggagagtatcctttttgcattaaaacattttcgtaattcttcttctcatccgcttcatgcttcgattattcagcatgtcagattgagtcgccattcggtacacgagagctccggctcccattgccaaaagagaagtcatcgtccgattcatcctgcgcatctcctttcatgattaaaaattgatgctgcgttcatcctcagaaaacaaatcatccaagctgcttaacgttccgtcttcttccacctgatgagttgcaatcttccctttcgccactgtcagttcaataaaacagccccagcaataatattggttcacgccgattttgccgatatccttacttttgcaattcgggcatataagcatacctcacacctctatccgttcagaacgatctcgtctttccgcacctcgacaagcgaatccgctctttggatctggcgcttgcttcccgcaaggtcagaaaagaaaccgtccgagagttcatatgctacgattatgcccctgtccaaacaaaagtatacatcttccagcatccccaatatatcgccctcttgcgatttcacaagcttcatcttcatctgctcgtatgtgaagcatgatttcggaagaggcaaaagctgttctgaactgaccgaagccaatatgcggtcatcaagaatggaagagatatcacacgcccgtaatagcgcatgatgatgatgcaaaaagcgtttttgtgcaagaataaacccaagacaatctcctttcagagaaaaacaaatatcggaaattgccccgagataacaagaagttcgttctgagtatactgggaatccttctacttcatggcatgttctcaaagtgtgatcaaccaccttttgttgaacaggcttaggttttgctttgcgccttagactcatacgatgaaatcaattccactgcaaatgaaaaaaactcccgcttgcacgggagcattttattgctgttcttctttcataaaatcgaatggtgtaatgccttccatgccaatgttggcgtcgtgtacgctgaacgggagctctttttggagagcctcaagctcggcatccatttcctcaacctgtacggacagcctgttttttaaggaggtctgtctgacagttgcatcattatttttcacgccccactccagcgcctcctcttccccgcataaaatgagaaatttcttcgctcttgtaatcgcggtataaagaaggtttcttctgagcattctataatagcctttcacaacaggcaaaaccacaatcggaaattcacttccctgcgatttatgaatagaacagcaatacgcatgggtaaattgattaaaatcttttttcgtaaatgtcatttcattgccgtcaaaagaaacgacggccatgtcttctttttctgtattttcctttgcataaaatatcgacgtgatttcgccaatatctccgttgaacacattgttttccggctgattgacaagctgcaaaattttatctccggttctgtagacaacatccccgaacttcaattctctccgtttttctttaggaggatttaaaatgtcctgcagcatcacattcaattcattaatgccggcttttcctctgtacatcggagcgaggacctgaatgtcctttgctgtatagccttttttcaatgcattggcgacaaccttctcaactacttctttgatttgcgacccgccgcagcgaataaaggaacggtcctttgtcggggcagtcaaattgttcggcagcaatccatttttcatctggtgggcaagctcgacgattgatgacccttctgcctggcgatagatgtctgtcagtctcacagtcggaatcacctgggatgccagcaggtctctgagcacttgtcccggaccgacggaaggcagctggtcttcgtctccgacaatgatgatttgtatatgatcagggatcgccttgaacaaatgattcgccagccatatatcaagcatactggcttcatcgataattaacagcttcccttcgatcggctgatcctctgtatgagtaaagccttcagcaccgttccagccaagcagcctgtgtatcgtaactgcaggaagtcccgttgattcactcatccgttttgctgctctccctgtcggagcggccaaaacaatcggaaaagcttcatcctttttataagctgacggatctagtgacacaccgtgaagctctccgtagagctcgacaatccctctgattaccgtcgttttccctgttcccggaccgcctgttaaaagaagcatcggcgaggaaagggctttttgaatcgcttccttctggctgggggcatactgaacgttcatccgttcttccagttctcccaacgcgagcaaaaactctgattcgggaaactggttctcatattcggtttggctagcgatatgtttcacacgctttgcaacgttttgttctgcgtaaaacagcgaaggaaaataacagcggccatcttctatgacaatgtctttattttctccaagggcaataatcgcgttagcggcatccatttctgtgatgcgctgcccttcccttgctgactggtttaacagagattgggtgtcaatgatcagctgttccgtttctatgtacgtgtgcccctctgacagacaagtcgtttcaagcgtgtacaaaatagcagcttttacccgctcaggatggttacccgaaagacccattctgctgcccagctcatccgctttcccaaacccgatgccttctacatccttcacaagctgataaggattttcctgaatcttttcaagcgtctcagattcataggcttgatagattttcatagacagctgcgggccaaaaccaaactgattcaaggaaatcatgatttgctccagtccctgatgccgctgcaatgcgccagccagcgtgtcggctttcttttttgagagtctgggaacatcataaagcactgaagcgtcagccaatattttattaatggcgctgtcgcccagctttttcacaatttcttcagctgtttttttgccgatcccctcgaataaatcactcgataaatattgaatgatgccttccttagtcgttggaatctcctttttgaaatgctccgcctgaaattggagcccgaattttggatgagttacgatctttccgtaaaacgtgtaggtctcttcttcttgaagcgcagggaagtagcccgtcacggatacggctttatcttcaatggcttcggaggtctctgtgactttcactttcagaaccgtatataaattggtgtcattatgatagatgactgtgttgactgtcccttttaaatagggctcttcctccagtttaagctgatccggatgctgctgcacgagctgtccctcctcctgtgcctgttatgatggatcaatcagttttttagcatgaagcgcaagcatatgatctggctggatatcgattgccttgtccagcatttccagcgctttttctcggttttctttataagcataagcgacaccggcattataaaatgcatctgcatgccccgggtcttgctctgtcacagctgagaattggctgagcgcttcgtccagcatgccctcgttggctaagcacatcccgaattgaaagcgcgcttccgtatcgttttcattcagttcgactgctctttgtaaatatggcagtgcaagcttaggctgttcgagcttgacaagcaccgttccgagcatgtaaaacaggtcgccgttttccatccccgcacgaagcgctttttcaaacatgtctttggcttctttgtacatttcttttacaacatagacatttcctgctccataataagcagtggctgcgctactgtctaattcaagcgctttatcataaaacgcaagcgcacgttccagctcgtttacggatgaaagaaggttggcaaaattgatatacggaatcgcgtcttctttattttcttcaatcgcttttgtaaatgcctctgccgctttctcgtaatcgccttcctgcatcgcctctataccgagttgattataatccaccgatcatcttcctttcattaaaaaaccccaactcagtgttgaggtttttcatcttttatacgtaccacaattttgttccgtctttgtacacatcatcaattgtcccgccgccaaggcattcttcgccgtcatagaagacaacggcttgtcccggcgttacagcgcggacttgttcatcaaagatgacttccgcttcaccctcgccagtcatgcgcaccgttactttatgatcttcttggcggtaacggaatttagccgtgcaggaaatctcttcgcccttcatgatatccgaacgtacccagctgatatttgttgctgtgattttgtcagaatataaaagcgggttatggaacccttgatccacgtagaggatgttcttttcaagatctttgcctaccgcaaaccacggctcgccgcttccgccgatgccaaggccgtgacgctgtccgatcgtatagtacatcaacccgtcgtggcggccttttacttcgccgtccatcgtcatcatatcgcccggctgtgcagggagatattggctgagaaacgttttgaagttgcgttcgccgataaagcagatgcctgtactgtcttttttcgtcgccgttgcaagttctgcttctttggcgatttcacgcacacggcttttttgaagttcgccgatcgggaacatgactttgctcagcgtatcttctgtcagctgattcaggaagtacgtttgatccttgttttcatcaatgccgcgcagcattctgacttttccgccgcttctgtctactcttgcatagtggccagtcgctaaatagtcggcgccaagtgacaatgcatgctccaaaaaggctttgaatttaatttctttgttgcacaatacatccgggtttggtgttctgcctgctttatattcatcaaggaagtattgaaataccttctcataatattgcttttcaaagtttacggcataatacggaattccgatttggttgcagacgcggatcacatcttcataatcctctgtcgccgtgcaaaaaccgttttcgtccgtatcatcccagtttttcataaagattccgattacatcatagccctgttcttttaacagcagggccgccacagatgagtctactccgccggacatgccgacaacgactcttgtatcctccggccgtttttccatttcattcactccaattactacgccgccttattgtgtcagccgtttgacaacgtcggccacatgtttggcagcagttttcacttgctcagccgtattgccgaggccgaagctgattcgaatagaggacgtcagccggtcactctcttcgccgaacatagcagtcagaacatgtgacggcaggactgaaccggccgtgcacgctgaaccgctggagacagcgacaccagccatatcaagattaaccagcagcgcttccactgacacaccggggaaataaagattcagaacatgcggcagactatgctctttgtccccgttgacctcgaatgccacacctgcatctctaagcgtgtcggcaaagattgctttaaacgattgatacttctcgtttttttcgtcacgttcttcacttgacagcttgatcgcttctttcagcccgacaatgcctggaacattttccgttccggcacggcgttttctttcttgctctcctccgaataaaagcggtgaaagcttcacatctttactagcatataaaaagcctgtcccttttggcccgttgagcttgtgcccggaaacagacagaaggtcaatatggctgtttttcacatcaattggcagcaacccgaatgcctgaacagcatcggtatgaaaataagctttgtgttcctttaacagctcaccgatttcttcgatcggctgcactgttccaacttcattatttccatacatcactgtcacaaggattgtatcatcacgcagtgcttctttcacctgttttgcactgactcttccattttggtcaacgtccagatacgttatgtcaaatccgtcttcctcaagtttttcacatgtgtgaagcacggcgtgatgctcaatttttgttgtgatgatatgtctgccaagatcttttcttgcaagtgcggttcccatgatcgccaagttatcagcttccgttcccccgcttgtaaaaatgatctcctgctctgccgctccgatttctgctgcgatctgcgctcttgcttcatccacccattttcgagattctctgccaaatgaatgaatactggagggattaccgaaactgccggagaagtgcggtatcattttttccagcacgcgctcatccatcggagacgttgcggcatgatctaaataaatccgttccattatgtttacacctctgatctaaatatagaacatataagcttcttgctctccgtctgtatagctggcaagatcctctaatgttgtactgtctaaaacctcttttacagcatcccggatgcgaatccagagctcacgcttggcaggctcctcatcttccagcacttcaacagggctgatcggcccctcaagcacacggataatatctcccgcagtaatggcatccggctcactgcctaatacatatccgccatatgcgcctctgatgcttttcactaaaccggcatttctgagcggcgataccagctgctccaaataatgctcggacaaattattcgtctgtgcgatgctttttaatgaagtcgggccttcaccgtgcttttttgcaagctcgatcataatggtgagcccgtatcttcccttagttgatattttcaacatgaacacctctgttatttcatgattttccacatttataatggtaatttctatatgtttcgtccgtttattatcttatagaccaactgttattataacataccttcagcgaattttcattgaggcagaaggaaaggggcctttacccttttctaatgtacggttttccgttaccctgtaattaagtaaggagagatgatagatgaagccattggcatatcggatgcgtccgacaaaaatagaggatattatcggccagcagcatctggtggctgaagataaaattattggcagaatggtccaggcaaaacatttgtcatccatgattttgtacgggccgcccggaattggaaaaacatcaatcgcaacagcaatcgccggttcaacaagtattgcttttcgaaagctgaatgctgtcattaacaataaaaaagatatggaaatcgtagctcaggaagccaagatgtccggccaagtgattttgattctggatgaagtccacaggctggataaaggaaaacaggattttctattaccctatttagaaaacggaatgatcattttgatcggagcaacgacggctaacccgtatcatgccattaatccggcgatcagaagccggacccagatttttgagcttgaaccgttaacacctgatctgattaaacaggcactggaacgtgcgctccatgatgagcatcggggccttggcacctattctgtatccattgatgatcaggcgatggagcattttgcccacggatgcggaggagatgtccgctccgctttaaatgcgcttgagcttgccgtgttgtcaacgaaggagtcagcagacggtgaaattcacattacattagaaaccgcggaagaatgcttgcagaaaaaaagcttttctcacgataaagatggtgacgcgcattatgatgtactgtccgcttttcaaaaatcgatccgcggctctgatgccaacgctgctcttcactatttggctagattaattgaagccggtgatctggagagcatcgcaagacgattgcttgttatcgcctatgaagatatcggtttagcaagcccgcaagccggtcctagagtgctgaacgctattcagaccgctgagcgagtcgggtttcctgaagcgcgaatcccactggccaacgcagttattgagctttgcctctcaccgaaatcaaactctgccattctggcaatcgatgaggccctggcagatatcagagccggaaaaattggggatgtcccgaagcatttaaaagacgcgcattataaaggagctcaggaattaggaagaggaatcgactataaatacccgcacaattacgacaacggttgggtcgaacaacaatacctccctgatcctctgaaaaataagcaatactataagccgaaacagacaggaaaattcgaatccgccttaaagcaggtgtacgataaattaatgaaaagaaaataaaacaaaaacagccttgatcatcaaggctgtttttatgcattatttatccttcacacgtttgatttcaatgtctttcaaaagatccatgacaacatgtccgcccataatcaaacctgcaactgacggcacaaaagcattagaggaaggcggcatttttgctttacggattttcgcttcgtcattccccacttcttttctgacatcttcccgaatgacaatcgggctttcatcagagaaaatcacttgaacgccttttttgataccctccttgcgtaatttcgtacggacgaccttcgcaattggatcagtgtgcgtttttgagatatcagcgatttggaagcgtgtcggatccgttttatttgcagcacccatgctggagatgagcggaatatcccgtttcagacattccttcattaaatgaattttataacaaatggtgtctgacgcatcaatgacatagtcaagatcatagtcaaaaaactgctcatacgtttcctccgtatagaacatttttaacgagattacttcacactccgggttaatgtctgcgatccgcgccttcattaaatcaactttcggctgtccgacagttgaaagcagcgcgtgaagctgacggtttacatttgtaatgtcgacatcatctttgtcgacaagcagaatgcggccgacgcctgaccgcgcgagagcttccgccgcgaacgacccgactcctccgactccaagcacagcaactgtgctgtttttcagcgtttcaaggccttcttttccgatagctaattcattgcgtgaaaactggtgtaacaagaacctcactccacattcgtattctggtttcatctataaaatggctgatccatgagcagccgtttttctgcgcacaaaaaataaagtcccaatagtgccgttgcagctttcctttgttttgaacccgctctcagcaggtgggtgccctcttttaaatcttgtaagtcctctttaccgaatgaaaagaggcatgtacgccatttaaaaatgcgggctcccaaatcaaaaaaatgttcggtcaaaactaggtgtacaactaacacatcaggactttatttaacttgtcaaaatcatatcacagacgattttgattttcaagaatccaactgcacattcagttcttaacttttttcttgatagaaagatgaagctcgtcaagctgagcgtcacttacttctccaggcgcctctgtcatcaggcagcttgcacttgccgttttcgggaatgcaatcgtatctctcaggttcgtacgtcctgcgagaagcataacgagacggtctaagccaagtgcgattccgccgtgcggaggagcgccgtattcaaatgcttccagcaggaatccgaactgttcagccgcttcttctggtgagaagccgagaagcgcaaacattttttcctgaatatccttttcaaaaatacggattgaaccgccgccaagctcatagccgtttaagacgaggtcataagcttgtgctttcatgtcttcaggcgctgtttcaatcagctcaaggtcttctcggacaggcattgtgaacggatggtgtgctgcgtaaaaacggccttcttccggatcatgctctaataacggccagtcgatgacccataagaaattaaacaatttttcgtcaatcagcccgcgctctttcccaagctttaagcgcagggcgccgagtgatgcggccacaacttcgaattgatccgctccgaacagcagcaaatcaccttcagcagcatcaagtgcttcaatcagcttagactgcttttcttcatcaaagaatttagcgatcgggcctttcactccgtctgcctcaaccttcacccaggcaagcccttttgccccgtagtttgcagcaaaagcgccaagagcgtcgatgtcttttctggagtaatcgccggcaccgccttttacgttgatggctttaaccacgccgccgtttgctacagctgatgagaacactttaaattccgtatcctttacaatgtcagacacatccgtcaaaagcatgtcaaaacgcgtatccggtttatcagaaccgtacttgttcattgcttcgtcatacgtcattcgaggaagaggaagcttaagttcctcaccttttgtttcacgcataacctttgccatcatctcctcagccaatgacataatgtcttcctggctcataaaggacatttcaatatcaatttgcgtaaactcaggctgacggtccgcacgcaagtcttcatcgcggaaacagcgggcaatttgataatatcgttcaatgcctgataccatcagaagctgtttaaatagctgcggggactgcggcagcgcatagaactcaccttcgtgcacacggctcggcaccaagtagtcacgtgcgccttcaggcgtgcttcctgttaaaatcggcgtttcaatatcaagaaacccattttcatctaaaaagctgcgaacagctttcgtcacgttatggcgcagctgcatcgtctggaacatagccggtctgcgcaaatctaagtaacggtgttttaaacgaacgtcctctgacacttcttcagcttgatcagaaatcgcaaatggaggtgtctttgcagcatttaatacgttcactccatcagcatgtatttcgatcgcgcctgttttcaaattcggattaactgttccctcttcacgcgccaccacttttccttgaatatcaagcacgtattcatttctgatgccttccgcgatagcaagcgcttcttttgacacatcagggttaaaaacgacttgaacaatgcccgtacggtcacgcaagtcaataaaaatcaatccgccgaggtctcgtcttttttggacccagcctttcagcgttacagattcgccaattgctttttcagttatatcaccgcaataatatgttcttccaaacaatgcgtttcactccttatcccttttggtttgccttcatcacatgtataaattcatcaagtgccacttcaatctgttcgcccgtctgtgcatcctttacattgattttgttttgggcaagctcatcttcacccaaaatcgcaataaatctggcctttaagcgatcagctgttttaaactggcctttcattttcttattttcataatcgatttcactggaaatgcctgcttctctcagtttgtacaccaatgaaacagaataatcctttgctttttcgccgagtgtgacgatatagcagtcgattcccttatcaacaggcagctctcttttttcagcatcaattgcggcaagcaagcgttcgatgctcatcgcaaatccgatgcccggtgcttcaggtccgccgatctgttcgacaagcccgtcgtagcgtccgccgccggcaagtgtcgtaatcgcgccaaagccctccgcattgctcataatttcaaatgcggtgtggttgtaataatccagccctctcacaaggttcggatcgatttcatacgaaatgccaagatcatttaagtattgtttcactttttcaaaataagcggctgattcttcatttaaatatgtcaaaatcgaaggtgccgatttcatcagctcatgatcacggtcttttttgcagtccaaaattctaagcgggttcgtgtgcagccgggactggcagtctgaacaaaattcttcgatgcgaggctcgaagtgtttcacgagcgcttctctgtagcttttgcggctatcttgatcgccgagactgtttatgacaagcttaacgttttctaaacctgctttttcataaatactcatcgcaagcgccattacttcagcgtcgattgcagggtctttcgaaccaatcgcttcaattccaaactgataaaactggcggtaacggcccgtctgaggacgttcataacggaacatcggcccgacataataaagctttgtcggctgtacaggatttgcgaacagcttgttttcattaaaagcgcgaaccgcagcagctgttccctccggacgaagcgtcaggcttctgcctttgcggtcctcgaaggtatacatttctttttgtacgatatccgttgattctccgacgcctctggcaaacagttctgtatgctcaaaaatcggtgtgcggatttctttatattgataagtgcggcaagtgtctctcataatttgttcaacaaactgccagcgatctgattctccaggcagaatatcctgtgttcctctcggaatgttatatcccataggtagacctccttatgtattccttataaaatatccaatgatcgttaatgatgaaaatgaaaaaaactcccgcccctactatacatgatagtagggacgagagttatacccgtggtgccaccctagttggaatacgttcatattcccgctcgatcctttaacgcaggttcacgttcactgcctaatggcgttattcacgcgttcagcaggaaacctccggagtgttgtttcgagaaagacgcaatgggatccgctttcagcctggggcgggttcctctctaatcatgcaatctgacctactcttctccattattggttcaaatctttcatcatttgctatgtactcaatttctattataataatgggattggggttctctgtcaagctttattccggttgtttttcctcagcgctgcttctttggacataagaccaaattcagatgctgtttccgtaagataaccagtcgtatcgggatctgcgtgatcgctgtaatgcagattcgcttcaccgtcgtgaaatgcacgtcccatttttggatgatatttcatgatttgcacacctttttgattgtatttacgcttagtataaacaaatcattttatttttatttaaaaatcagaaaggactttacgatattaaacaagaatgcttttttaatgatcatcagaaaggaggacacaatgaacaagaaatactttgtccttattgtatgtattattttcacctcagcgctattcccgaccttttcatccgttacagctgctcaaggagaagcggtcatcgcaacagatgaaatgaacgtcagaagcggcccagggcttagctacggcattacagcggaagtaaaaaagggagaacgctatccaattttaaaggaagatggagactgggtgcagatacagcttggttctggagaaaagggctgggtagtctcctggcttattacaaaggaagaccaggccagcacaagctcctcaggaagcagtgacactgtgacatcaacagaccccgatctgcggatgagaagcggcccgggcacttcctacgaagtcatcggcaaattcccgcaaggcagccaagcatctgtcattgataaagattcgggctggatcaagatatcctatcacagtgccaccggatgggtatcatctgaatatgtcacatcaggaggcagcagttcagcgtctgatgagagtgaccaaaccgaggattccggtgcgtcaacgacgggcacagtcggtgtttcttcgctaaatgtaagagcctccgcctcacatgacgcggcaattataacaaaacttgatcgcggaacgaaactgacggttctcaacgagaaaaatggctgggctcacattgaggtgaacgggctaaaaggctgggttgcaagccattaccttttgactagttctgttccagctgatgattcagcaaatgccggcagttcatcctccgctaaaaaagcctatatcatgtacggaggaacgaatctaagaagtgatgcgtcaacatcagcttcgatcgttgagcgcgctgccaaaggagattcatacaccattaccggttcaaagggaagctggtatgaaataaagcttgataacgggcagactgcttatgtagccaattgggtggtccaaacgtctaaaagcgcagaagaagcaggtgaaccgccagtctctgattccccgtctggaaacggctctctaaacaataaaacgattattgttgacccgggacatggaggaaaagacagcggaacgatcgggtattcggggaaattcgagaaaaacctgacgatcaaaacggcaaaactgctcgccagcaaacttagatcggctggagcggatgtatatgtgacacgccaggatgatacctttgtcagcctgcagtcacgggtctctacctctcactaccgtaacgctgacgcctttatcagcattcattatgacagctatgcggatacctctacaagaggcagtacagcatattactacagtcctgccaaagatcaggaactcgcatcagatgtccactcagaagtggtgaagcgttcttccattccagaccgcggcgtattattcggagattattatgtgctccgggaaaacagacagcccgctatgctgtacgagctgggatatgtaagccatccgcaggaagaagccattgtacatagcaattcataccaagaaaaagtaacagatgggatcgaaagcggattagagaaatacttccaataaaaaaagctgccttttggcagctttttttattttgaatccataatgagcgtgaccggtccggagtttgtaagctgaacatccatcattgctccaaacgttccggtctccactttgattcctttttcacgaagcaggtcattccatttttcataaagacctaaagctttatcaggtttggccgcgttcatgtagttcggccggcgcccttttttcgtatctccataaagcgtaaactgtgagacggataaaatctctcctcctatatctacaagagacagattcattttcccttcactgtcatcgaaaatacggagattgacaactttatcggctaaataagctgcatcatcttctgtatcatcgtgagtgatgccgaccagcaccataaggccttgtccaatttggccgacgacctcttcgtccactgtaacgcttgcttctgttactcgctgaacaactaatctcattttctaacccctttagttcatgacgcggcgcacagagtagatatctctaatctgtttaatacgctcgacgactttgtgcaagtgattgatattctgtatgaaaatcgccatatggatggttgccactttattgcgatccgatttgccagagacagatgaaatattggttttcgtttcattcactgcctggagcacctcgttcagcaatccgcggcggtcatacccaagaatctctatctcaacattgtattccttgcgcttttgaacttgtgactcatgctcccactctaccgggatcagccgctcttgggcttcattcgttttgacattcggacagtcttcgcgatggaccgaaacccctctgccttttgtgataaagccgacaatatcatcacctggcacaggattgcagcattttgataaacggacaaggaggttgtcaatgcccttgacacgaacgccagcttcccgttttcttccttgcgggtatggcttaggttccccagtgacttcctgaacgatcttttcctgttcttcctgatcgcgctgctttctctctttttctgttaggcggttcgccacctgcagagctgtgatgccgttgtaaccgaccgccgcgtacatatcctcttcatttgagaaattaaatttgtcagcaaccttttgaatattctccggcgttaaaacatccttcaattcaaaatccaagtttttaatttctttttcgaccagctcacggcctttttcgacattttcttcacgccgctgtttcttaaagaattgacggattttatgcttcgcttgggatgtttgggcaagcttcacccaatcctggctcgggccgtaggaatgcttagaggtgagaatttcaacgatatcacctgtccgaagcttatggtcaagcgtaaccatttttccgtttactttggcaccgattgttttattgccgatttcagagtgaatccggtaagaaaagtcaatcggaacagaaccggacggaagctcgattacatctccttttggcgtaaagacatacaccatgtcagagaacaaatcaattttgagcgattccataaattcttctgcatctgtcgattcattttgaaattctaaaatttcacggaaccaagaaagctttttctcaaaggttgcaccttcattggctgctttcccttctttataagcccagtgagccgcaaccccgtattccgctatttcatgcatttcaaaggtgcggatctgcacttcaagcggatcgcctttaggcccaataaccgttgtatgaagcgattgatacatattcggcttcggcattgcgatataatctttgaatctgccgggcatcggtttccagcatgtgtgaatgatgccaagcaccgcgtagcagtcctttatgctattcacaagaatacggacagccagcaaatcgtaaatttcattgaattgcttattttgcagcaccatttttcgataaatgctgtaaatatgtttcggacgtcccgagaagtcagccttgatatttacttcttcgacacgtttcttcacttcattgacaacctcatcgacataaagctcacgttctgcacgtttcttcttcatgaggttgacaattctgtaatattgctgagggttcaaataacggagcgccgtatcttccaattcccacttaatttttgaaatcccgagacgatgcgccaaaggagcaaaaatttccagcgtttcattggagattctccgctgtttttcctgaggcagatgtttcagtgtccgcatattgtgaagacgatccgccagcttgatcaatatgaccctgatatcttgagccatagcgacaaacattttgcgatgattttccgcctgctgttcctcttgagatttatatttaattttgccgagtttcgttacgccgtctacaagcattgccacttcttcggaaaatgcttctttcaggtcatcgagcgtcacatctgtatcttccacgacatcgtgcaaaaatccgcccgcgattgtggaagggtccatttcaagatcaacgagaatccccgcaacctgaatcggatgaataatatatggctcgcccgatttgcggtattgctcgcgatgagcatcttcagcgtacagatatgctttttcgacaaatgcgatatgctcatcagatagatagctgcgcgctttatctataacttgctcggcagtcaatacttgttcgttcgccatggaatcaccttttttaaaatgtaaactgtattgtagtttattatcaagaaaaaaacgaaagatgtaaagagcagaagttcaaatagccaaatattatataaaataaatgcaaaacaataggaaaaaagcaccctgacatggagtgctttttcgttatgcggttatccttagtatttcatcaatgttaagatgtcgtaatcttcgagcttatttctgccgtcaaggtaagaaagctcgattaagaaagcgataccagcaacaacgccgccaagttcttcaacaagtttgattgtcgcttcaattgtgccgcctgtcgcaagcaggtcatctgtaataagcacacgctgaccaggcttaatcgcatctttgtggatcgttaatacgtcttttccgtattccaagccataatccactttgattacttcacgaggcaacttgccttctttgcggaccggcgcaaaacctacgccaagcgcgtaagcaacgggacagccgataataaagccgcgcgcttcagggccaacgaccaaatcaatttgcttttctttcgcatattcaacaatttgatctgtggcatagcggtatacatcgcctttatccatcagtgtcgtaatatctttaaattgcacgccctctttcgggtaatccggtacaattgttacgtattgttttaaatccatctgttttatgtcctcctcgtactttcataagcctctgaatcttgtttcatcagcttattcagccattccttcagctcttcagcagaagaataattcagcttttgatccagttccatcagctgctgtttcgcctgatatgtttgtgagtctgttaagtcgcgtttctttgctccgctcacaacagacagcacaccattctctattttaacaaaaccgagatcaaaaaacacctttgtcatgaaattgattgtttcaacggaccagcctttatgttttgcaagctctgaaccgtgttttttcacgtcaaaagcgcctcttttcagcaagaacgcataataccatttaaagtggtctcttgcgggaaaagttgataaaaagtggtcctcatgattgagaaaaataaaatatatccgctcgggcgcctttccttccagcaaacgtgcgagcatgtccagcgaaggcggcggatccagtaatacaatatatgcaccatcgaggtcaaacgcctttgcttgatctttagaactgatgacgtgcacttctcggcgaaggtcttcagtttgaagtaatgttgttgagtcttctttgaaagagacaatggcccgtttagcagatggaagggcggaaactgtgtcttcccacgtccgttttccccttaaatcaaacagctgccattcagaaacagcggcatcctttatcataagctgcggcttttttcgattgttccattcgttgattgacatctcaccgacaatagaaattcttgaacccggtacgatgccttcttcaagctcgcctttattaaaaccgacgcaatcaagctgggacgactcgtttctgatcgtcattttgacatgagttttatttgcccctatcttgcggacatcttccagtactgcgttttctacgagaacgtgcggtttcgggttcagcatgccaaaaggagacagcatgttcatttctgcgatgctttcaactgtaatgtcttcgacgccgcagacaaggtcgacttcctgtacgggaataaaatcctcttccgtaagcgtattgtccgctatttcattcagcctgcttcgcaaatccggcacatcttcggctttcagcgtcatccccgcagccattggatggccgccgaaatgaggaagaatatctctgcattcagaaaggctctcaaataaattaaatcctctgatgcttcgggccgaacctttagcgattcccttttcttcatcaataccaagaacaatggccggtcggtagaaacggtccacaagctttgaagccacaatcccgacgactcccgggttccatccggctttggccacgacaattgcagtttgatcgagcccttgctgttcaaccatgtcaatcgcttcatccgtcattttgctgaccattttttggcgctctttgttcagctggtcaatttctgcggcaagctcttccgcttcaaacgaatcctctgacataagcaaatgaacagcgggatccgcctgttcgattcttccgacggcattcagccttggtgcgagctgaaatccgactgtttcttcgttcgcttctccgatgtctccgcctgacagcttaatcagctcttttaagccgagccgatttgtccgtcgaagcctttcaagtcctagtgttgctattaatctgttttcgtcatgcagcgggactagatcggcaatggtgccgatagccgccaggtcaagcagttcatcaggaagttcacccaataaagcgtgggcaagcttaaacgcgactccaaccccggcaagctctttaaacgggtaagtgcagccaggctgcttcgggtggacgatcgcacggacatccggaagctccggtcccggttcatgatgatcggtaatgatgacatccagtccgagttcctttgccaccttcgcttcatgcacagcggcaattcctgtatcaaccgtaatgatcaaagagaagccccgttctttaattgaacgaaacgcctgttcattaggtccatatccttctttaaaacggtcaggtatataaaaatcaacttgagccgacagtttttgcagcgtgtgaagcatcactgacgtacttgtaaccccatcggcgtcataatcgccatatatcataatcttttcttgttgtgaaatcgcctgttttattcgatctgccgcttctttcatgcctttcatttcaaaaggatcataaaaatcggcatcctttgtatgtaaaaacagcctagcgctttctgccgtatcaaagcctctttttacaagcagggacgcaacaagaggtgttatatgcaattgttctgtgagtgatttgaccttatcctgatctggtcgctggatttcccatcgcatttttgacgctaacataaattcacccctcaaccaccctattatactagagcaggctgaggggtttcaaataatattcgaaaactagtcttttttctcaatcatggctgatgcatcctgtgtgtcagtctgatcagcaagatgagtatcctcttgtttatgtattgctgttctattttctttccgcaaggtttttatttcccgcttcaatttcattacctgaaaaatgccgacagaaaatacgatcagtgctcccattaaaactgagcccaaaataacaagaatgagcggccattctgatcttccaaacaggtaatcaacttctacggatcgaacattaatgactgcgaaaatagcgacaattaaggtgaaaataagtgcgaaaataatggtccattgtttattcattctcttttcccccaaacttcttattgaggtaactttccccatcaagactggttttaaacatggcttaacactaggttaagctccctttgctgttaatttttcccggatcagcctcttcagtccggttccctcaccggaaatcacaagtgtatcgccttcgtcaatgactgtttcagagctcggattcagttgtttatcctgattctttttaacaattgcaatgaccgtcacatgatattcctgacccacattcaaatcaccaatcgtctgatgaatggcaggcgctcccgcctctgctttacaccactctataatcaaatcatcaagggctgactcgacctgttctaatgctttcggtttatatgccattccgccaagaattgcagacatttgccttgcttcagcgtcatcaaactgcacggaggcaacacattcctcatggtcgttttcgtcaaaatagtaaagctctctccgtccgtcatgatgaatgataattgaaattttatcacggtttctagtaatcatttcaactttttgtcctatgcccggcagctctgattcgcgaaccctcatatataaaccctcctacatatctgaaaaccagccataaacacttttaacaccatatatatgtttaaatgtaagcgtatgtcattatagcaaatgtctattttaagttcaatgaaacttcaaaaaacaggctgccctgcagaggacagcctgatattttttattgcgccgaatcttttttcagttctcttcctttccatgcaagccaaatttgtgcggcaatgtatagagaagaataaacgcctgttaacagcccgaccaataaagcaattgagaagttagtaatagaagatgctccaaagatcagcaatgtcacaacaacaatcacaacggttaatacagtgttaattgaacgtgtaaaggtttgctgcaggctcaggtttactatatggttcagatcggcaaatgttttcggcttacgctttttcatatgctcgcggaccctgtcaaatgtaacgattgtatcgttaatggaatacccgattatcgtcaagatggccgcgatgaacgtaacatctacttcaagccttgtaatactgaagaatgtgacgataaagaatgcgtcatatagcaatgaagcaatggcagcaatcgccattttgtattcgaatcggattgaaacgtaaataatgatgccaatagaagctatagcaactgcgtacagcgcatttcttgccagctccttaccgactgtcggtgaaactgtgctgacatttggctcagacccgtatttgtctttaaaatacgtttttacttttgctatggtttctttatctggcaccccgacaaaacgggcaacaccgatattgctcttttcgcctgacagaactacagtatcagggtccatacccagagattcaaaatccttctcaacttgctctgtcgtcagcttatggtcgctttgtacttcaatccgtgcaccgcttgcaaagtcaatgccaagattcagcctgaacacaagcaggataataatcccggcaaccgtgaccgcactggagaaaataaagaagtatttgcgtttgctcgtgaaatcccatttttggaatggcgtatgcggctctgtattttcatccgtatcctgaatatccatgatatgtttcttattgacaccaaaccagccttttttccgatcaagccatctgctttccacaaggagagcgaggagaaatctcgataagaaaacggcagtgataaagcttgtcaaaatcgataggatcagcattgtcgcaaaccctttaacagagcttgtcccaaagataaagagcacaaccgctgcaataatggttgtaatattcgcgtcaaaaatcgtcgcaaatgaccgtctgtttcctgaacggaaggcagagcggactgactttcctagcttgagctcttctttaatccgctcataggtaataatgttggcgtcaacagccatcccgacacctaaaatgagagcggcaattcccggaagcgtgagtacggcattcatccagtcaaagatctggagtgtaatgtagatataaacagacagcgtaatcaccgcgattaatcccggcagacggtaatagaaaagcataaataagaaaataattgcgataccgacaataccggcaaacaccgtatcatggagagcctgctggccgaattgtgcgcctactgatgtcgaatatttttcagtcagtttcacaggaagtgcgcctgcatttaaaatgctggctaaatcttttgcttcttgaaccgtaaattgcccttcaattgtaacatcagttgtgtttaattcctggcttacatttggggcggatacatatttagggtgctctttttgaacctcttttttaaaggagtcccctttttcgtaatccatccaaataacaagctggttgtttggcgccattttcatgacctttttggtcacttcgccgaatttatcagcatctttcagtttaatgctgacaatcggttcatttgttttggcgtcatacgtttgtttagctccgttttcgacgaggtcagagccattcagcaattctttgtcattcgtatctctgaaagaaagctgcgcttcagtcgccaaaatttcacgcgctctgttttggtttgtcacaccagcgagctgaacgcgaatccggttattcccttcaatttggatgttcggttcgctgacaccgagaacattggcccggcggttcaatgcctctactgtgctgaccagaacgtcttttgtgattttgtcacctttttttacaggctgtacatcatacagcacctcaaatccgccttgcaaatccaatcctaacgtaatattgttagcggcaggcttcgtaaagtagcccaagcccgtgccaatcaatagaacgaaaaggaaaaacgcaatcaagcgtccttttttcattatgtatatcctcccttaaacctgtgcgaatcaacctgctatctcagcagttcttccaatgcttcctggccctcttcactgcccagccaattagacgttttaaatgactcaacggttgcatagttcataaattcgccaattttcactgataaaatatcactcgccagttcataaatgttcagttccgttttctttttccacttcttatctgttaagtatgaccacaaactttcgagttcaacatcatcatacccgagaatcttaaactcttccagtttgctgtaaagaaacggcctgacgtggtctttatatagatcggctggatgcttctccacgaattccacgctccttttttattgtttttcaagaagacttgtcatgcttggacgatatatacgcatatctttattgtatatgattccaggtagtttgagaaggcagggggtaaaaatggcgaaacagacgtttttaaagggcactcttatccttatcgcagcaggaatggttacaagaatgctcgggtttgtcaaccgggtggttatcgcccgttttatcggtgaagaaggagtcgggctttacatgatggcggcgcctaccttcttcttggccactacattaactcaattcggtctgccggtcgcgatcagcaagctagtcgctgaagccagtgcgcgcggagatcatcaaaaaacgaaaaatattttagtcatgtctctgaccatcacgggagtgctcagcctcatctttacaccgctgtttctgtttttcgccccggttatggctgaaacgatgctgacagataagcgaacactgtatccgctcttggccattacgccggttgtgccgattattgctatatcgagtgtgctgaggggatactttcaaggaaaacagaatatgaacccgcttgctatgtcacaagtccttgaacaggttgtccgcatttcactcgtggctgtctgcacaacgatttttctcccttacggaattgaatatgctgcagcgggggcaatgctatcctcagtggcaggggagctggcatcacttctttatttattcgtttgctttaagtataaaaagacaattaaaatcagaaagcattttttccagtcaattaaaaacggaaaacaaacctttacccaattaatgagcgtgtcccttccaacaaccgggagccgctttatcggaaacctctcttggtttttcgagccaatcgtcgtcgctcaaagccttgccatcgccggtgtggcaacagttgccgcaacaaagcaatacggggaactgaccggctttgccatgacgttgctgactctgcctagctttattacatattctttgtcgaccgcgcttgttcctgcgatcagtgaaggaatggagcagaaaaaattgcaggtggtggaataccgcttggaacaggcgatgcgtctctgtctgctcagcggaggcatttcagttgttattttatttgtatttgcggatgagctgatgagagtgatgtacggttcttcaggcgcagctgtatttataaaagtgatggccccgttttttctgctttattattttcaaggcccgcttcaagctgttctgcaggcgcttaatttggcaggagctgcgatgatgaacagcttaatcggagcgctagtcaaaacaggccttatttttgtccttgccacaaggccttctcttggcattatgggcgcggcattagccattgtgacaggcatggtgctcgtcacgctattgcacgcagcaaccgtaagcaaagtgctgccgatcagcatcaaaatcaaggagtacgcgctcagcttcgctgttattgtaatttgcggattcatcagctccgccatcaaacattatataagctttggagcatctgaggctgtcaatctagccggatggattgcggtgagcgccgccatttatatgatcctcctgctcgttttccgtttaattaaaaaagatgagcttcgccgcattcccattatcggacgtctgatcatccgataatagtcacgtgcggtacccatctttttcgtcaataaataattctccgtctgtaaacgagcaaaatgaaatatctgaagggtttgtgtatccgtgtttttgcaaactttcaagcagccattttctatctttactgattctggacaggttttctgtttgaatgaagccgtctataatgagcggcatttcgagctgccgatgctctccgctattttctttctttacaatagtcagtttgcccgacggctctaaaatggcaaatgatacgtcagctactctgtcgacgctattttctctgagttgaaccattaaatcatcaaaattatatcgctgtgatttcatggcttcttcgtcaatttttccatatttgataattatagtcggcttaccgtcaagaagctggcggacttttcggttttttaaagaaaagtatgccaaagtcacttgaatgatcattaatacaagcattggcaaaatggtatgaaatagatgatcgtctacgttttctatggctaaaacggcaatttcagccatcatgataaagacaacgagatctaaaatactaagctctccgatctcccgtttgcccatgaaacgaaaaatgaccaatatcacaaaatacaatacgactgtgcgaaacgcaatagtgagaagctcttccatcatgcacctccaactcattataggttgcaacaaaatgatcaatttatgtaagaaaaaccgattgcatttcacaaagcttttacgtctaattcaagggataagggaatacatttttacaaagacgagccatcagcatgtctgacggctttgtgcaaaaagaacagaagccttttaatacaggcagagaggagacaatcatggaggaaacgaaacaagttggaaaaggcattctttacggcttaatcgccatattttcagccatgctcctgacaagtttggcggtttcacttttattgaccgcaacctcgctggaagaatcatcatttaactggctgatcacagctatctcatttctctctttatttatcggcgggttcatttcaggcgggaaaggcaaggaaagaggctggatgattggcgcattgaccgccttaagtttttctctgattatcttattgtttcagtatttaggattcggaaagacatttacagcagaacagctgatcttccatctgggatttttaggggtgtgcatgctgggcgggattttcggcgtgaacatgaggggaaacaggtcttccacataaaaaagagcgggctcacttgcccgctcttttttgtttgctatgtatagctcctgctgttattcagcagcagaaacttctctgatcgcgcggcggtcgaacgtaagacgtgtgttatcaccagtcttaattacgactttgctttcgtcgatagagtcaacagtaccgtgcaatcccccgattgtcactactgaatcgccttttttcagttcctcttgcatttggcgtacagccttttgctgcttttgctgaggacgaatcagcaagaagtaaaggaccgcaaacattaaaataataggaaccaatgtacctaaagtgccagtcatcattttcacccctttctgtaagcctgttatgtttatttagaagcttttcgcatttggcttgttatagccgtaacgctcaaagaactcttctctgaaatcacccagacgatcctcgcgaatagcctgtcttacctgctccattaagtgtaacagaaaatgaaggttatggtaagttgttaatcgaaggccgaatgtttcattacagcgaatcaagtgcctaatgtacgcgcgagtgtagtttttacatgtatagcaatcacactcttcatcaatcggacggaagtctctttcaaatttcgcatttttcatattgagtcgtccttcagcagtaaacactgtgccgtttcttgcaatccgtgtaggcagcacacagtcaaacatatcgaccccgcggatcgctccgtcgatcagtgcatccggagaacctactcccatcagatatctcggtttatccttcggcaagagcggtgttgtaaattcgagtacacggttcatgacatccttcggttcacctacagacaatccgcctatagcatatcccggaaaatcaagcgaaatcaagtccttcgcactttgtgtccgcagatcttcatattctccgccttgtacaataccaaacagcccttgttcatcctgacgattgtgggcattcaggcagcgttccgcccagcggcttgtccgctcaactgacctcttcatgtagtcgtactccgccgggtatggcgggcattcatcaaacgccatcataatatcagagccgagtgcgttttggatctccatcgctttttccggagataaaaacagcttgtctccatttagatgattgcggaaatggacaccctcttcctctatattacgaaacttgcttaaagaaaagacctgaaaaccgcctgaatcggttaaaattgcgcggtcccagttcataaatttatggagcccgcccgcttctttgacaatgtcttggcccggacgaagccatagatgataagtattgctcaaaatgatgcctgcatccattgctttcagctcttcaggcgacattgttttgactgtcgccagtgtgccgaccggcataaaaaccggcgtttcaaaggagccgtgaggcgtatgcactttgcccagccgcgctcctgtttgtttgcattcttttataaattcatagcgtattggttgttcagccacttttgatgaggcctcctgttctcaaattatataatcagcatcgcgtctccgaagctgaagaaacggtattcctcttccactgcatggttataggcacgcagaatgttttctcttccagcaagcgcgctgaccagcataatcaatgacgatttcggcaaatggaagtttgtaatcattccgtcaatggctttaaattcatagcccggataaataaaaatagatgtccagccgcttgatgctttaaattgcccgtcatgttccccggcaatcgtctcaagcgtgcgtgtcgaggtcgtgccgacagaaatgatccgaccgccattttctcttactttgtttaaggctgcagccgtttcttctgacatttgataaaactctgcatgcatattatgctcttccacttcatcggcactcacagggcgaaacgttccaaggcctacgtgcagtgtgatgaactcaatttgcacgcctttgtctttcagctgctgtaagatttcttccgtgaagtgaaggccagctgtaggcgcagcagcagagccgatttcttttgaatacactgtctggtagcgctctttgtcatcaagctgttctttgatatatggagggagcggcatctctccaagggattcaagcacctcgtagaaaataccgtcatattgaaattccatctttctgccgccgtgctcaagctcttccgtgcagattgccttcaatcttccgtctccaaatgtgacaacagttccttttttcacccgtttcgccggtttggcaagtgtttcccatttatcaccggtttcctgtttcaacaaaagaagttccactttcgcgccggtatcctcttttgtgccgaataaccgcgcaggcagtacccgggtattgttcaggactagacaatcgccttcgttaaagaagctgataatgtgtttaaacgagctgtcagtaagctctcctgtatgtttatcgagcaccatcagccttgaagcatcacgctgctccaacggtacttgtgcaattaaacgttctggtagttcaaaatcaaataaatcgactttcatgatgatttcacctttattctagtcttttgttatttcattctgccaaaaagattaagcaaaattgataataccacacttataataatacaagtgacaaccgggaagaaaaacgtgacatttcctttttttacaaaaatatctcccggcatcttgccgacaaaatgcaaaactgctccgataataagcaaaacagcaccaagaatcataatgatcttaggaaattcagtcatatcggggagcctccatttggaaatgatgataaacggccggtgtcacgatccttccacgcggcgttctttgtataaatccaatttgcagcagatatggttcatatacgtcttcaatcgtatgcgattcctcgccgatggtagctgaaatcgtatcaaggcctactgggccgccgttgaatttttcgatcatgcccatcagcagcttatgatcaatatgatccaaaccgaggcggtcaacctgaagccgctccagcgcattctgagaaatgtcttccgtaatcctgctgtcacccagcacttgggcgaaatcgcgcacccttctcagcaggcggttcgccacgcggggcgtccctctcgatcttcttgcaatttcaagagccgacggtttatcaatctcaacctcgaatacatcagcggttcttgtgacaatatccgccagttcttcttgtgtatagtactcaaggcgagacatgacgccgaatctgtctcttaaaggagccgtcaaaagccccaccctcgtcgtggctcccaccagcgtaaaaggcggaaggtcgaggcgaaccgagcgggcagatgggcctttgccaatcacaatgtccaggcaaaagtcttccattgcaggataaagcacctcttcgatcgatctgtgcagcctatgtatttcatcaataaataatacatctcccggttccagcgccgttaatatagcagccaaatcaccaggcctttcaatcgcaggccctgatgtcgtccgcaattccactcccatttcattagcaacaatcgaagcaagcgttgtttttccgagtccgggcggcccgtacagaagaacatgatccagcgtctcctgtctcattttcgccgcatctataaacacgcgcaaattttcttttaccttatgctgcccgatatactgtgccagattttgcggcctcaggctttgctctatcactgattcatggttgtctgcttcacttgagacgagccgttcatccatgaacatcaccttactttaatagtttttgtaatgcttttttcacatattggtctgttgtcagcccaatttcttctttaaggtgaggaagcacctttttgatttctttttcagcatatccgagaaccctgagggcttcaagtgcttcttcaagagccgtttccgctgtttgcttttcaagcctttcttcatgattaaacagattttcaatcatttcaggcacaacatctgccagctttccttttaaatctagaataatctggcgtgcggttttttttcctactccaggaaacttgaccaaaaaagcttcatcttcattttcaattgcttgaatgaccgctccgggatcacccgagcccaagatggcaagtgctcctttcgggccaattccggtcacgtttaacagctttgtaaagagcgccttctcctctcttgttgaaaaaccgtaaagcgaaaaagcatcctctctgatatgatggtatgtaaaaatcgtttcctggcttctctccttatatataaagggattcggcgtgaaaatctgatagccgatgccgccgttctctatgacaatatattggggagatacataatcaatcgtccctttaacaaattcaatcacgcaaattcacctctttgactgttcttcattgtaccataaaaacagccaaagtcttatagaaaagttaacatacgttcgcttctctctcattctttcacgaaaaaaaagacatgaattcatgtcttcaatcagcggacgttacccgctgtatgtcttcatatgttcgatgacatcctcaaactccgcttttgtccgaaatggaatgcctttcagcagatttttttgcatatggctttccagcctttctaaatcaatttgaaaaaaagactgaattggttcggaagctggctcaggccgcccatgaaaagtggaaatcactccattatccgatacaccgatatacccgttgaccttgctgagcggagaaatatcgtccatttgcttccggaagagcacatatccctttttttgttccacaagcgtccatccggcataagctgcccaaaaatcatccatagaaaacactttttcatgcttatgctcaatgctgacatcgccgtccaaatacaccttttcaagctgcacatgcacctgcagcggctcatagtgctccacttccgcgccaagtgcgcgggaaggagctcctattaaaaatactgccgctgagcaaagaatgcccagcaaaagatacgccgtgctgaatcgtttcaccctctacacctctttgcacacgtttatgattagtttgaccaaagaggctactgcttaaccgttttatcaaaatttgtctgcacattttccctgacaaaccgttcctccgtatacacatctgtgctttgctcagaaattgtcaagaatcgcgtcagaaaggcactgaaaaaatacaatgccgcaaagatccaaatcacgccgcctgcaccgagcggcccaatgaaaagactcacgatgcccggcgcgataaacgcacataaaccagatcccaaattcaacactgacatggcagcacctttattatcaggtgcaagcgtcggcaaaagcgcgcttaatgggacgtaccctgctaaagccgcgccgtagcagcaggcgataatcatgagcacccaatactgatgcccgatcagctgaggcgtgtaatacagcgccagcgtaaaaataccgcatccgacaccgccaaaccacatgaccgtattgcgccagccaagtttatctccgactgcaccgaaaatgatattaaacacaatattcacaaaaaacagcgtcccccatatttgcagccattccgaaaccgaatacccgtatcgtgctaaataagtaggaagaaagatggcaaatccaaattgtcctatcgcattaatcgtcttgaccactccgccgatgcctaccttagggttttcaaacataattgtaaatgccttcgacaattctttccatttcggctgatcttgtttttgtatcggagtaaatttatctttgttaaaaaataaggcaagaattccgcctgccgccacaaacagtaaagcgctccaaagcgtattgatttctccaaaggccggaactgcatagctggaatagaacgggcccagcacgttaaggccgcacgtaaacataaaccaaaaccagccgacggctttgccgagaatattttgagaggtgctgtatgacacccatacgagaaaagagtatgcaaacagcggatatcccaagcctctaagagcatagctgcccaagagagccggataatacatatgaggaatcgcccagccgataaaagcggccgaaccgaggataaatgcaagcaatccgacagtcatcgtttttctcggcccccaagtttggacaaacgttcctgaaagccaagctgagatggtgacagcaatgccgtacatggtaaataacgatgcggattgctgcatactgagaccatgatcaacgagaaaaggagacagccagccttgttcgaggccgtctccaaccataaagatgacaacgccaatataaccccaaaccatgtgagaaggaattccgattttgttcaaaacatttcctttagcatgtactgtattcattttctccaccgcctacttaaagtatcaatggagtatatacccaagcttgctgaattgtaatcctgttagattaaaaagcgattttttcagtgtgctcaatgctgacaggcatgccaaaagcaagcgattgctgtgctgctctggcgatccttccggcctgtaaaccgtcattgccggtgcagggagtctcctggtttgtgccgatcgcttctgcaaaacggagaatctcctcctcatatgaatccttatagcgttcaaggaaaaagaaatgcggtttatccttcatcacaaaatcagctgttgacacctcaaccgttgtcggcctgctattatcagccgctgcagagcctttcgtcccgaaaacctcaacccgctggtcatatccgtacacagcttggcggctgttatcaatcacagccatggcaccgttttcaaaagtcagtgtaataacagctgtatcaatatcacccagctccgcaaaagaaggattcaccaaagctgcccctttggcatacacttccgtcacttcgcttcccataatatatctggccatatcaaaatcatggatcgacatatccataaacaatccgcctgacgtacggacataatctatattcggggttctgggtcccgggacgtgatttttaataaatgaggtgtaccgatttcaccattttcaacaatcgttttgattttcttaaaatgaggatcaaagcggcggttaaatccgacttgaagtgttacaccgtgtttccggacagccgcaagcgcttcactcgtttcgtccagagagaaactaacgggcttctcacaaaatatatgctttttcgcctcggctgcttctttgatcatctgtgcatgtacggctgtaggagagcaaataaaaatagcatcaatatcaggatcatgtaataaatcacgataatcagaggttatgtattcaatctgatgactgtcggcccagctttttatacggcttgcctgaatgtcagagactgcttttattttcatgtgaggaatccggcttatattttgaacatgaagtttgccgatgcggcctgcaccgataatccctgtcacaatctgttttgtcatggcttcttcccccttgatcattcacgaaagcgctttatttaaaattaatactatcccatttgtaagcgcttttcaagaatggaaattaaacgttctatgtctcttttatcacaattcatgcttataagtagccttcttcttcaagaccagatacactagaattaggctctttttcctgaacagtttatgattttcctataaacagctgcataaaatagagcaaagaaggtgaatgaaatgctgacaaaagcagaggcactggcccataccgtcatataccgcaagaacagcagatttgataaagtcaaagagaaatccgaggaattaacactaatcggcaagggaagaagcgcctatgtgtttgccttaacagaaggcggtcgaaaaatggcgctgaaagtattttttccggaatatcaagcgacagcagtcaaagaagcagcgatctatgaaaaattagccgggtccgcattctatcctgacatttacgaaactggcgattcatttattctcatggaatatattaaaggtgaaaccttttataactgtctgaagaaaggcattgcaatcagtgatgacatgattcagcaggttgaagaagcgctttctgacgcccgggcagccggactgaacccgtcagatattcatttgcggaatctgatattgacagaaaccggggcggtgcgggtgattgatgttgcgagatttgagcagacaaaaacatgcacgcagtgggacgacttaaaatccgcatatcatgcactctacaaaaaaccgatattccccaaaaagattccgggtttttggctggagatcatcgcatttttatataagaaagattggtttcaaaagcatttcgcacagcggaaaagaaaatattcttaaatcaaaaaggcagccgcacaagcggctgcctttatcatgtattttttactttctgacggcagaaatcagtttcatttgttcaggcgacagcttaattcgatagcctctcacagttaagtagaccgcttctgggtccttctcaccggaatgacaatacgttttttccatttctgtctcccctcaccctttattggctttatttcatcttatcattgctttattaaggtagttttaaagaaatgtaaagatcatatgaatccgatatatagtaaaatgagagaaaaaaagggagagagtcacattaagacacgcagcaacatcccgcttattatgtttgccctgctggtcttcttcggcggcgccatctattggatgttattttcactaaaaaacgttccgaaaggcaatctcgtccaatcggttgattcgccggacggcagctatacgttaaacacttatgtatccgaaaacatcttgagcttagatgcagccagaggtgaacttgtaaatgaaaaaacacttgtcaagagaacaatctactggaattacccggacagccgcccagcagtgacgtggatcaatcacaatacagtgaaaatcggcaatcagactttacatcttgatactgatgaaacgtatgattggcgaaaagatgatcattggatccgtgaaaaaccgccgcaggcgtcagtgaggtgatgaaacatgaataagatgaacggaacaaatgatgacaagcatttcaatcattttgtgattgctttatcctttatatacggtttgactgaactaggctatttgttgctgaaggattttataacaattgccataagtttgcctctgtagaaaaacgcagcgtagtcgatacgccgcgttttttctttttcccttcctcttcttattgttaattacaggtcatataatgtgacaaatcgattgtagaaatagttcgattagaccaaaatcctttttatacatgtattcgaatttgaagtgagggggaagcttgatggcagattttgttgctagtttgaatgcggtcttatggagtacgcccgtcatttatattttattgggaattggattcaccttttcaattatgacccgttttttacaagtccgacatttaaaagaaatgattgttcagatgttcaaaggcaagagctctgaagccggcgtttcatctttccaagcgttatcgattgcgctgtccggccgtgtgggcacaggaaacatcgcgggagtggcgacagcaattgcattcggcggacccggtgcagtgttctggatgtgggcgattgcctttatcggggcggcgagtgcctttgtagaatcaacgcttgctcaaatttacaaagtgaaacaagacggtcaatatcggggcggccctgcttattatatagaaaaaggcttaggcattaagtggtttgccgtcttatttgccgctgctgcccttattgcaatggcctttctaatgccgggcgtacagtccaactccattgcggctgggatccaaaatgcattcggcatctctcctttcgtcacagggtgtggtctggttttattattagggttcattatttttggcggcgtcaaacgaattgccaatgcggcgcaaatgattgttccatttatggccattggatatatcctgctgtctttgattattattgtcatgaatgtgtctgaattgcctgctgtgatctcattaatattcaaaagcgcctttgcattggattccgcttttggcggcttgatcggcatggcgatttcctggggcgttaaacgtggcatttattcaaacgaagccggccagggaacaggcccgcatccggcagctgctgcagaggtttctcatccggtcaagcagggactggttcaggcattttctgtttatattgacaccttgtttgtatgttccgctacagctttcatgatcttgtttaccggcatgtacaatacccaggctgcagatggttcctttatcgttcaccagcttaaaggcgtagaagcaggacctggtttcacacaagcggcaattgacagtgttcttcccggattcggtgcaggctttgttgccatcgctttattcttcttcgcttttacaacaattatggcgtactactacatcgcagaaacaaatatcgcctatttagcacgaggcagagaaagcaaatgggcgatgcttggcttaaaactgattattttagccgccacgttctatggtactgtgaaaacagcttcacttgcttgggcattaggggatgcagggcttggcattatggtatggctgaacgtcattgccattgtgctgcttgccaagccggcgctccttgctttaaaggattatgagcgccaaaagaagcagggcttagacccgatctttgatccaaaagcgctgggtatcaaaaacgctgatttctgggagaaagaatacactcatgaaagtgaacgtgtctcctgaacatactaaaaccggcccgatatgacctcgtgccggttttttatgaacgatagtttgtatacacttcttgaacatcatcgtcatcttcaaggacgtctattaatgtttccagcttctcaacagcctgatcatcggcttctgcataggtattgggaagcatggtcacctccgccgaagaaattggatatttcgattcgagggctgttttcacctcttcaaaatgctcaggctctgtgaaaacctcatataggttttcttcaattcgcagctcttctcctcctgcttcaagcacatcaagcatgagctcatcttcttctatttgccattcagtacggtctatcgtaatgaacccctttcgttcaaataaaaaggctacacatccgctttctcccagacttccgccatttttattaaaggctgtccgcacatttgacgccgttcggtttttattatctgttacgcattcaaccatgacggcaatccctgaagggccgtagccttcataggtgatttcttcatagctgcttccgtcttggcctcccgcagcttttttaatggcccgatctatattttcattcggcatattggcgccttttgctttttcgatgacaagacgcaatgctgaatttgcttctggatccgctccgccttctttcgctgccacatagatttcttttgccagcttcataaatattttcccgcgctttgcatcctgtgcattttttcttttttgaatgtttttccacttggaatggcctgccatgttttcaccttcttttacattttctatgtacactttaatgggaattgttcgctgatgcaaagaaaaaggctgccgaatatccttccggcagcccttccttcctagcggttgttcattttatgaagttttctgaacagccctttatctgttgatacttggacgtcacggccatttgcatagttgcgcgctgcttttacgacattatctctgtcagactttgtgaactctctgtggcttttgactgcgataactactcggtcatcggataccataacttgtgtgtcattgacgtttttcacttgtttcacacggttggcaatttttgcagccagtcttctgttttcttggttgtcatacccgttgttcgctgcattccgattcatgtttcggttattcgtgttgttatatgttccgtcagttgccaaaggaacacgatcgtcagcagtaacacggtcacggttatttacattcgtggtgtttcggttaccgtcgttctgatcctccattaattcagaaacaggaccatcgtggtcgattccgtctccctgtctatcggcgtcattttcatttgtataatatccgattggacgggtattgccgttattgcgcgtatcattcatagcattatcgtttgctccgcatgctgttaagccggctgtcattagaatcaggctagcgatcgtcatttttttacccaatggaaaaaccccccgtggacgaattgagcatgtttgctcgcttttatcatgtgcgtatggggggcatgttaagcgtgtcagttctctccatttggcagtgatcagcttgaaaataaaaaaaggaacgatttacatcgttccgaacaatcactcattttcttcttccggccggccaaacatttggtttacagaaggctggttcgtcattggcatagaaactcctgccgaatatgggtttggatttgggttagctgtgccatatggcatattagggcttccataagctcccattcccgaatggccaggcgcagagaaatatggctgatgatcaccgtcacagccgcagtcgtcatgatctttgtatggcatgtaaccatgagccgcagcaggctggtatgctcccattacttggggagtgccgtaataagggccatacggcatatgtccatacggagatccataagccggagatgcgtattgcggcgcaccgtatgaaccgtaatgtccgtgatggctgttttcatgatgctggttttcataacccgggtcatactgaggcgatacaaatcctggctggtatccatgcatcggatgcattggataagcttgtgccggatagtacggatagcataatcctgatcctggaagaattggcgaaacaggcaccggacacggtacgaaatgagccggataatgataataaggctgaacagccggcatcggcatattcggaactgtgtgatgaacgttttcctcttctacaccgcctacctctggcgcctttggcatattaggcatattcggataattagcattttccatattactcatagcctcctgttgtggaaattggtcttgcatatgatacatatgatccatatttccgtcatgatgtttttttggctcctccggtttaggaggcgaccaaggctggaaaagctgtttcatatcataataatcgttcacatcagcttcagggtacacattttcctgcaaattaggcatcggcgggacatacggcatggacttcttttctttcggctttgtgtcttctacatcgacaacggatttaggcttctctttcgcatatggatgttcttgcttcacactcccggccgcaggacttttgcccgcttttggctcttttctgaccgggactccttctgacggcacttttattttcattccaggcatgattaagtctggattgctaagctgtgtattgagttttttcacttcctcaacatcgactccgtacttttcagctattttccagagcgaatcgcctttttgaacgatatggattttcaacgttttcccctcctatgcaaaacgtgaacagttcagctgtgattacaatatgtttcttcacaacatatgcctgaacaaaagaagttatgagtaaaggaagggaaaatatttctgatctacgtgatcgaaagcattcgattcagggcaaggagtgcatcttcctgaatggcttttggcaccttgatgacgcctgaaggttctcctttttcaatttgttccagcgaccacaacaaatgcggcaaatcaattcggttcattgtcaggcaagggcacatgtcagggttgagtgattcgatttgtttatctggatgctcgtgaatgatccgcagaacaagattcatttctgtcccgattgcccacttgcttcccgccggagcctggttgattgtgtcgataatatatttcgttgatccgttatcatcgcttagtgtcacgacttcgtgtgaacattccgggtgcacaatgatctgaatgtcggggtctcgctctctcatatcatggatatttttagtggtgaatttctcgtgaacagagcaatgccctttccacaaaatcactttcacattcgtatgcccggattcagctactaattcatctttcatcggatcccacacagccatatcttcaagcgcaatgcccagatcataagccgtatttctccctaaatgctgatcaggcaaaaataaaattctttttttctgtgtaaacgcccattcaagcacttttttcgcattcgaagaagttacagttgctccgccatgctttccgacgaatgccttgatctccgcagtggagttcacataagttaaaggtatgatcgtatctccaaatatatgctgaagcttcttccatgccctattggtctgctgcatgtcagccatgtcagccatagaacatccagctctcatatctggcaggacgaccgtttgctgctcgcttgtcagcatatcggcggtttctgccataaagtgaacgccgcaaaatacgatataatccgcttctttgtttttttccgctacttgggccaattgcagggagtcgcctgtttggtcagcaaattgtatcacttcatccttttgataatgatggcctggtataaagagcctgctgccgaactttttcttaatggcggcaacgcgcgtttccatatcctttctcgatagttctttataactttcgggcatcatatcattcgattgtttgatcacatcaagaattgacataacggcattcctccacagattcatttgataacgtaacatccatgctgatatctaaacttttgacggaatgagtcagaaatcctaatgaaatataattcacacccgtccctttaaaagcaggcaaagattctaacgtaatcccgccagaggcttcagtttttatatgagccggtgtgagctttgcaaaatgacggaccgtatcaggcggacagttgtcaaacataataacatccgctccagctgcaattgcttcccgcagctgtccctccgtttcaatttccacctcgatatttaccatgtgccctgcggcctgacgggcttttttgcacgcctctaaaatagagccgcatgctgcgatatgattatctttaatcatgatgccgtcatacaaaccgaatcgatgattatacccgccgccggctctgacagcatatttctccagcattctgagccccggtgttgtttttctcgtgtcacaaattttaatctgttcatcatccagacaccgaacagcctctcttgtcattgtcgcaattcctgacagtctctgaataagatttaatacgacccgctctcctgaaaggagcgcagctgcgggaccgtgtaactcggcaatcacttcacctttatgcaacatgtccccatcttttttgtttaaaatgatttgaacattttcgtccaataacgaaaagccttcttttatgatcgctgctcctgcaaaaataccctctgactttgcaacaatctccgcttcacagctctgttctccaaaaatagactgcgatgtaagatcccctgtcccaatatcctcaagaaaaaagtgattcagtaattttttcagctgtaaatgattcattgttccaaatcccctcgttttttctgatcttcgttcctttttttgtatggacaatttgtcttccttgccagcccacctcagtatgaggaaaatcggttcggaagtgagcccctctgctttcctcccgcaaaagcgcagaaaacgtcatcagctttgcagtttgccatagatgagaaagttccatctgccgaattgtgatatccttcacatttacttcctgaaaaggcagcgtatgaagccagatgctaagctcaatcaaactgctttgttcccgcagaatagacatgtggcttgtcattttgctttgcagttcatgcacctctatatccggcacctcgtagaagacactggtttctagccctgattgatattgcctgttataagccggtttttggataatatgctctgctgccctttttccaaataccagcgcttccaataaagaattgcttgcaagccggtttgctccatgtaaaccggagcatgctgtctcgccaatcgcataaagccccggcactgtcgtttctccccagcgattaactgaaacacctcccattaagaaatgcattcccggagcaacaggaatttttccgctgtggatatcaatccctgctttttcacaaatagcggtgatagtagggaaacgcgtttcaaaatcagaaatcgcactgaagtctatataaacgcgatttccttttgccatttcttcgtgaataacccgtgagacaatatctcttggagccaggtcacctaaaggatgccgttcagccataatcctgcggccgttttcgtctactaaacatccgccttcccctctgacagcttctgaaacaagcccgtagaaaacaccatttttcacaagcagtgtcgggtgaaactgagtaaactccaaatccgttaattccgccccggcccggtaagccagagaaagaccgtcacctgtgacagtgagatcattcgtatggtgaagaaacaggtttccacagccgccggcagccagcacaacttcgtctgcgtgccttaccttgagccgccctttgctgtcttttgtcatgacgccgatacatcgtccgtcctctataagcaaatctgctgccatttcattctcgattaacttgattttgctgttgatccgtttgagcaaataatcgataagcagcctgcctgttgcgtctccgcctgcatgaaatatgcggttgtatgagtgggccccttctcttccaagacaaacaccgcctcgttcattgcggtcgaatggaaatccacgctccaataggctttgaaccatcatttttccatcatgtaatacgtctgctgcaatagctagattattatggccgcatcctgcgtataacgtatcctccagatgggcttcaatcgagtcatcttttgcataggccgcagcaatcccgccttgtgcatagacagaattgctgtttttgacgcttttttttgtgataacagtcacttcgtatgagggcgggaaagctgcagctaaggaaagtgccgccgcccctgaaccgatgactgcaatcgtctttttagacatatgccatcctcctgttgtttacacctgtcttgacacctatatttacacaaggataaaataaactcaagagttttttatggagaacggatggaggaagaccggatgatttatttagattatgcagcgacaacgcctatttgtgaggaagcccttactgtatatcagaagcttagtatggatatgtacggaaatgccagcagcctgcatgatgcaggaggaaaagcaaagcacatactggagtactgccgtgaaaaaatcgccaacatcattggcggagaagcaagcggcatctattttacaagcggcggcactgaatccaattttctggccattcaatcattgctaaacggcctgccaaaaacgaaaagacattttattacgactgccatggagcatcagtccattcataattgcgctgcttttttggaacagcagggatatgatgtaacagtcattgaaccgaatgaatacgggcttattaccgaggaaatattactagcccatatccggccggaaacaggccttgtatctattcagcatgcaaattctgaaaccgggatcattcagcccattcaccgcctgtcttcatacctgcacaataagggcattcttcttcattgcgacgctgttcaaacgtttggaaagatcccgatcaatacaaaaaatctgggagtagatgcactctcaatgtccagccataaaatccacggtccaaaaggagtaggggcggtctatatccgtccggatgtcccttggaaacccgtttatcctctgactactcacgaatacggattcagagccggcaccgtaaatgttcccgggatcggtgccttcactgccgctgcagaattgatcgtaagcgaaatggaaaaacagatatcccgcaatgaggcattaagaacttactttctagaccaaatccgtattcggtctctccctgtaacccttgcggcagacacttcgcaagcagaatgtcttccgcatattatagggtgtttttttcactcatttgaaggacaatatgttatgttagaatgtaatcggagtaatatttgcatttcaaccggcagcgcttgttctgcaggttaccacggtccgtctgaaacaatgaaagcattaagaaaaaccgaacaagaagctctgcaatttatccgcatctcttttggcaggcatacaacagctgaacagctggaacagttattacatacgtttacagtgctttgggaacaaaagaaaggagaatttgatattgaccgaagaattaaagctaatgggcgccaacaggcgtgaccagcttcttctgtggctgaaggaatctaaatcaccgctgacaggaggagaactcgcaaaaaaagcgaacgtttcaagacaggttattgtacaggatatatcgctcttgaaagcgaaaaatgtaccgattatcgccacaagccaaggatatgtatacatggatgcagccgctcagcagcaccagcaggcagaaagaatcatagcatgtctgcacggtcctgaacggacagaagaggaactgcagctcatcgtcgacgaaggcgttacagtaaaagacgtaaaaatcgagcatcccgtgtatggagatttaactgcagccatccaagtaggcacccggaaggaagttagccatttcattaaaaaaatcaattctacgaatgctgcctacttatcacagctgaccgacggcgtgcacctgcatacactgacagcacctgatgaacatcgcatcgatcaagcttgccaagccctcgaagaagccggcattttaattaaagactaaaaaaagccctctagagggcttttttataattggtaagactggtatgcacccaggagctttactttgcagccgagcgcttcaagctcctgcatggcccctggaatcaatacatcatcaaacgctttctcaatatcaataataaagaaataatggcctaatccggttttagtcggacgtgactcaatttttgacaagtttaaatttctccaagaaaatgcagacagcactctatgcagcgccccggactgatcatcctgcggcagcatgaccattaaggtcgttttgggcctagaactcaattttgaattcacttcaaaagatatgttttcatcaggagacaggataacaaatcttgtatgattgtccctataatcctgtatatcccgtttcacgatttttaattcgtatgtagaagctgccatatcattggcaatgaccccgatattcagctctggatggtcactgacaaactttgctgccgccccggtagaattggcgtattcatatggaacggaaggaaaatgtcgatggagaaatttatggcattgcgcaatcgcgtgtgaatgcgagtaaattctgtcgagctctttccatgcattctctcttgagggatgaacgagcaagtgctgatgaatcggcaacgtcatttcacccacgattggcaagggctgttcatgtattaaatagtctattgttagattaacagatccttctaaagcattttccaaaggaacaaaagcaaaatcaacttcgcctgcaacggctgcatctatacactccggaatggtgcggtaagcaacatgttcggcgccgttttgaaaacaagaactgactgctagatgtgtaaatgtagctgctggacctaaataaccgactttcatgacgattttctctcccttatgcacctgaacctaatatttcaaccttttctacaaaatcaaacttcctgagcttattcattaatgtatgaatgtcttcttccattgccgacgtactgatagacagtgtcacatttgctctgccttgaagcggaatggtctggtgaatggaaagaacgttgcttccagaatcagctaccgcctgaagaagctgagataacgcacctgacctatcctccaaatgaaagaaaagtgtgataatttgttcttttaccatggtgtagaatggaaaaacagcatccctgtatttataaaacgcacttctgcttaaatcgaccttttgaacggcatctgctactgaatctgctttttttcgatcaagcagctttttgacttctaatgtttttctcattgcatcgggcaatacatcttcacggacaagataaaatgtctcctctttcatttgcatcccccctttaaaatagagagcctggcaccaggctctcttttcagccaacattcattaatcaataaattcaaattcaaattccagaagcctgattatatctccatccttggctccgcgttctctgagtgcttcatcaacacccattccgcgcatctgtcttgcaaaccgtttaaccgattcatcacgtgagaaatcagtcatcttgaataaccgctcaaggctgtctcctgaaagcacaaatacaccgtctggatcgcgtgtaatgttaaatggcacttcttcattttccatcgtgtacatgacacggttttgtgtaagctcttcctcgtcatacagcgggaattccggtgtgttctcaagctgattggcaacctcaaacagaagctcacgcagaccttctcttgtcaccgcactgatcgggaataccggataatcatccgtcagcttttctttaaaggcttcgagattttccgcagcctccggcatgtccattttatttgcaacgataatttgcggacgctcagtgagacgcagattgtactcgctcagctcctggttaatcgtaagataatcctcatacggatcgcggccctctaagcccgacatgtcaatgacgtgaacaataaccctcgtccgttcaatatggcgcaaaaactggtggcccagtccgatgccttggtgtgcgccttcaatcagtcctggcaaatcagccatgacaaagctgcgtccgtcatccgtttcaaccatgccgagattcgggacaagcgttgtaaagtgatagtccgcaattttcggttttgcagatgagacaacagacagcaaagtcgattttcccacactcgggaacccgacaagcccgacatccgcaagcacttttaattcaagaacaatgtagcgttcttttcccggctcgccgttttctgaaagctgaggcgcgggattagccggtgtagcaaagcggctattccctcttccgcctcttccgcctcttgcaatgacagcccgctgtccgtgctctgttaaatcagcgatgacctgttttgtatcatcgtctgtcacaacggtgcccggcggaactttaataaccatatcatcagcatttcgtccgtgctggtttttggacatgccatgctcgccgcgaatcgctttaaagtgttttttgtatctaaaatccatcagggtgcggagaccttcatctacttcaaaaacgacgtctcctcccttacctccgtcaccgccggcagggccgcctttcggcacatatttttcacggcgaaacgcaaccataccgttgccgccgtcgccgccttttacatatactttgacctgatctacaaacataatgtcctccgttctaaaccgttaaaaactccgctagtccaacccaatctcaatcagacattcgtgactcgtgatttcaaaacgcatgatatcaacgtcctcatatccattctgccgaatatcatcaaaagcagatggatcggcaaaggcgccgtgaaaatcaaggtacagaatcagctgtctgtcaggatgatccgtttgaagcgaaaccgttaaatgattttcactctctctgctgactgcttgatcaaacagatgaaacagctttctcatcagtttcgccagcttttgatcataagccgacaaatccttaatttctccgagaacttcatattcaagcgtcatataatgggttttccaattaaacgtaagaaaatcaaacgccaaatgcggtgttttcaggtttgagagctttgattcgtgctttgcgtctataaccatttcttcaatcatttcaaagacgcggtcatacttctgcaagcttaagtttcctttaatcagctgcagcttattcatccaatcatgccgggaatggccaagcagatgaatcagttcgtttgttaatgccgtgtcgcttatattttcttcttgattttttgaaacatccttcattttcgcactcccaatcatttaatttcttatttaggagtctgtataagtgtgtattatgaattataacagagaaggctttgttagaaaaacaattgtttttcccagaaatatcatgttccttttttctggctttggttgatttgcagccaggcagaacattttatgtattactgcttggggaacatatccagtgggtttgagatgtttattctcattcttggcggggtctgctcgcacatactctgcatttcattctaggtgtttactccgcatattgcaaaaaaaactccagtcatcatcgaccggagttttttgaatcattattgagctacaggatatacgctcacttttttgcggtcacggccgaaacgttcgaatttaacagttccgtcgattttcgcaaatagagtgtcatctccgccgcggcccacgttttcacctgggtaaatttttgttccgcgttgacggtaaaggatagaaccgcctgttacgaattgaccgtcagcacgtttagcacctaaacgtttagcctcagagtcacgtccgttctttgtagaacctactccttttttagaagcgaaaaactgaagatctaatctaagcatgtagctcacctcctatattatgtttgtggtcacacgcaagttgtctttgtaatcccgttcgattgtctccagcgaaacaatcatgccttcaatcagcaactgagctttttggcgtgcctctggatcaagagattcagggaattcaaaataaaaataacccccgtcctcccctatatcaagaagcggctcgaagcccgcgagcacaatgaccgcgttaacggctccaaacacaacggctgtcactccggcacaaacaagatcttgtccatgttcagcaaaattcgcatggcccgtcatttcaaaagacaatatgcctttatcatgagacctcctgattgttgcctgaatcatgcttacgcgttgattttttcgatcgtcactttagtgtaaggctgacgatgaccttgttttttatgaacgtttttctttggtttgtatctgaaaacagtgatttttttcgcgcggccttgtttttcaactttagccgttactgttgcgccttcaactgtagggttgccgactttcacgttgtctccgccaacaaacaaaacgtcttcaaaagtaactgtttcacctgcttcagcagcaagtttttcgatgtaaacagtttggccttcttcaactttgatttgtttaccgcctgttttaatgattgcgtacattctctgcacctcctattagactaagactcgccagataccagggggctgtaaaagctcttaacacctgtactgagcggttgtagcaatggtgctacatccataacattaaaaaatataccaaaatacaagccgtttgtcaatcagttttagtagggcagaagcagttcctccatggaagaattcgtccgcttatcggcaaagtaagcgtgcagcacttcattctcgtcaagctggctgagcttttggcctgatttttctataataatcggatgcttacagccacgtttgaactcggccatcacatgatagactttatcctccgcctttactgtcagcggcagaagtttctcaagctccctgttttttccgtaatacctttcgaggagaaatctcacatggatatagtgcctttgccgatattcctcaaacaaggaaacagccagaaagacaaacaaaacccatgcgctgatctgcagaggaatcacgaataaaacccagcacccgagcaacaggcagaagcagagcgacgtttttagattaagccggtgagccttttgaaaaggcagctgtttggaaaacaacaaaaataacagttttcctccatccagcggccagatcggcagtaaattgacaaataagatagaaagattataaaaggtgaagagttcaaaggtatgctgatgaatcactgagacttctgcaagcatccaggcggcaaactgaagccagatgtgctgaagagggccggcaataatgaccgcaaactcttcctttaacggccgattcccgtgttcttccacttcgaccgttcccccaaacggcagcaaaaaaacacgcttgattctccaagaaaaaaatacggccagagcagcatgccccagctcatgaatcaatacaatcaggagcagacataataatgctttcatatggcctgtgagcaagcccagcgccgcgataatccaaagaaaaggatgcacatggatctttaagataaggtcgagccatttattcaaatgtaatcacctgaatcggatcaataaatttatcgccgtctttcatggcaaaataatagacccctttattatgatcatcaagcttaatcgaaccgagctttttgcctttatccacaaaatcatataaagcaacatccacatctttgagctcgccatagatactataggtgttgtcagcatgctgcaccttaaccgtcagtcccgtctggctgtctttgctgacttcaaccacatagccttcttttacactatcaatcttatcgctgcttgtttcgactttaattccttccccattgtcctgaaaatcctgctgtactttcccggatgcaggcgcgatcagatctttgcctacttcaatctgctgttccttatttttgtgttcaggagccaggaaagcaagcggatttccgaatttggtttcgaaccaatggcttgctgaagcaaattgaaattcagtttcaaaggttttggctacggcgggtttaatctgactgacgggtccaatgtttgttttataggctatagctgaaacgagaacaaggcaggccgacagaagacatttcaggataattgaatctgttttcaccaatgggtgttttccgttgaatgttggcatgttatcttcgtagaccggaagtgttccatgcttttcctgatccgttaccatcacccaggacgggggtttctgcttttcagaaactgtctgagtagagaaacgttttgagccggaaagctgctttcttcttttctctaatcgttttctgatttcatctgctctgtgactcattgccatcatcctttgcattcgttgggtttgtacatcatatgtcttgtccatggcaaatattcggtttagtcaggaacaaagcaggcaaaaacaaaaaaacctgacacagcatttgctttgtcagattcttctctttaattctatcacattaagatcttacgccgaaaaatgacttaatcttagccatcattcctttattttgctcttcaagcacctgtaaaggaacagattcacctaagatgcggcgggcaatattgcgatatgcaatagaagcgcgatttttcgggtccatcgcaatcggttcaccatggttggaagctttgatgacttcatcatcatcagccacgattcctagcaaatcgatcgacaaatgctgtacgatttcgtcgatatccatcgtgtcaccgtttttcatcaggtgatttctgattctgttaacaacgagccgcggcggttcaatattttcctcttgctccagcagccctataatacggtcagcatcacgaacagctgagatttcaggcgtagtgaccacaatcgctttatcagctccggaaacggcatttttgtacccttgctcgattccggcaggacagtctatgatgacatagtcaaattcctgtttgagctcttggaccatgtttttaatttgttcaggagcaacagctgtcttatcgctcgtttgagcagcgggcattaaatagagcagatcatcgaaacgtttgtcttttacgagcgcctgatgcattttgcatctgccctctacaacgtctaccagatcgtaaataattctattttcaagacccattacaacatcaaggttgcgcagtcctatatcagtatctactaagcatacgcgcttccctaaaatggctaaggcggtaccgaggttcgcagatgttgttgtcttacctactccgccttttcccgaagttattacgatagcctcacccaattcacattcctccctcaagccttgttagatcaggtcttaaatgagccaaatgttgaaggcgttcaatgaccatatttccgtctgtatctaaataagcacattccatttcgttccctttttgaatgtggtctggggagcgatttaacacatgattgattcttaattgtgtcggaagcatttcagaggcggcgatgaccgcttgattatttccattaaacccggcatgcgcgattcctttcagtgagcccagaacaaaaatgttccctccggccctgactgttccgccgggattcacgtcaccgatcaggagcaagtcgccttttacctgcagcacttggcctgaacggacaatttttgaaacagaaataatttcggcttcctctcttatctgctgtgcttcttttttagtaatgacttcactgtcaatagaatgaacaaacaaatctttctttgacgcaatcaattcggttagctgttcctcttgctccttatataaaaagcgatttcccagcttaacatgaacgctgattttctggccttttccatcggtatattgttcaattgacagcatattctgaagaccatcgagaagctcatcaaaagaacacgcatcatccagatgcaatgttagtccattctttgttccttttattgttacatattgctgctttttggtcttcacaatattcacctcaacaacatactcatttcgtcaaaaaaagataaaatcctttttactcatctctcaattctttctttagactcataaaaaacaatctaaatggcagaacaagaataagagctgctgcaatatttaataaaattgtcggtataaaccggtcaagcacaaatccgttaaacgtcataatatctttatgaatcaaagactgaatgccgaatacgtaaaattcgagcagacagacagccagaactgctatcaatatcactacaaatgcgtttgtatgtaacactttaaacgcttttgaagccaaatagcatagccctgcaaaaccaaacatgtaaacgcctaatagacttgtatagttcatgtcatatagaaaaccaaaaataaatccgtaaatcatcgcgtgtttttggttgataaaagccgacatgaatatcaatacaagcatcaaaaaacgcggggcgagcacttggtcatctgtaacgaaaggaaaatgcaccaaatctgtaaaaatgctttccgcagaaaaaacaagcatcataacgaaagggagaaggaaacgtttcacgatccttcctcctctgtatcgacagtcggcacgtcacggttaacaacgatcacattatttaaatctgtaaggtcagccgcaggttttacataagcaacctttgtcagtccataggaatctgactcgatatcagtcacttcaccgattgtcagcccttctgggaaaacaccgcctgtccctgatgtttcaataagatcgccttttttcacgtcttgtttatccttacgctcaataattgtcatcttaagacgttttttctctttgtcatatccttcgatcaagccgtagcctttgctgcctttttttccggaaatttttgtcgcgactctgttattgcggtcagtatcgcttaaaagctgaacagcagacgtaaaattgttaagtccggagcttttgatcttgccgattaatgcgcctttttcgtttgtaacggccatatctttcgctacgttttgctgagtccccttgttaatggtgacctgtttggcccaattatcagggcttctggcgatgaccgttgctaaaatcggcttgtaatctttaatcgatttgacatggccaagctcgtcacgcaaggatttgttttcttcttcaagctcttgaagcttggcttcatattgtgtctgtccgtcaagtttttctcttagacgctcgttttctttgtatgtgttttttaaatcattgatgttctcaaatattcctgcaaaaaattcggcaggcgtatgaaaaatattttgaaatactcccgtcgtatcgccgatcactttctcaggccaggtggtattgcggccgcccttcagcgaaaatccaatcatagccaccaatatgataatacacagaagtaatagcattaaccgcttattcggcatcgtgttacacctcttctattgaactcccgattatctagttttccctttgaaaagatggatgtgctccagtgctttccctgttccgatcgctacacaatcaagcgggtcttcggcgataaggaccggcatttttgtttcttcgctgatgactttgtctaaattgcgcaaaagcgctccgccgccggttaacactatacctctgtccatgatatctgctgcaagctcaggcggtgttttttcgagtgtgctcttcactgcttcgacaattgtagatacagtgtcgcgtagagcattagaaatctcttttcctgtaatttcaattgttttcggcagacctgtgagcaaatcgcgtccgcggatttccatgttgtcggattcttcaggagcttctgcagatccgatttccattttaatcgcttcagccgtacggtcaccgatcatcaggttgtacgtttttctgatgtagttgataattgcgtcgtccatctcatcaccggctacacggattgactgagacgttacgatgcctccgagggaaataatcgcaacttctgtcgtaccgcccccgatatcaacaaccatgcttccagtcggttcccaaactggcagattggctccgattgctgcggcaaaaggctcttcaatcggatacgcgtcacgcgctcccgcctgtcttgtcgcatcgataacagcgcgttcttcaacagctgtaatgcctgatgggacacataccattacatatggttttctggcaaacatgcctttattttttatggcttgattgatgtaatatttcatcatcgtcgccgttgtttcataatcagcgataacgccgtctttcatcgggcgaagagccaccacgttgcccggtgtccgtccaatcatatttttcgcatcatttccgacagcgacaatcgatttcgtatccgtctgcaaagcgacaactgacggctctctcacaacaattccttttccttttacaaaaacaagcgtattcgcagttccaagatctataccaaggtctctagcaccaattccaaacatatgtatgtatcttcctttcttaaagcaaaaataccctaaagggaaaaactcataaactctattatagcttaattcgacgaaaaaaaaagtgttacaaatatcctttttcctttaaactcacaaattttttatccccgatcaccaaatggtcaagcagctcgatgccaatcaggtttccgcattcaaacagccgtcttgtcacttcaatatcctccctgctcggcgtcggatctccagaaggatgattatgaacacagataaaggaagcggcagatcgtttaaacgcttctttaaacacctctcgcgggtggacaatagatgaattcaggcttccgataaatacggtgcgtttatggatgacttgattttttgtatttaagtataaacagacaaaatgctcctgggttaaaaagcgcatatcctccatgacgagattagcgccgtcttccggggagcgaataacgaaatgttcttcgttggctaatttgtgaatccggcttccaagctcaactgcagccagtatttgaatcgcttttaccataccgattcccgggatgcttgacagctcttcaaccgatgcttccttgagcagacgcagcccgtcaaatgagcgcagcagccggtttgacaggtccaaaacagattcgtgtttagtccctgtccgcaataatatagccaaaagttcatgattcgctaagttctcggctccgactttcaggagccgttcccttggcttttctttcattgggaaatctttgagttttaatggcagatcgcgtatgaccaagcactccttttctttcccttcccgtttatagaaccgtcatgcccttatatcaaaatggcgaagagctctcattgtttttgatataggaaggcccatgactgaataataatctccgtctattttctttacaaaaagcgcgcctcttccttggatgccgtatgcacctgctttatccatcggctcttttgtttcaatatatgtccaaatctcttcttcactgagggaccaaaacgcaacttctgtcttatcataaaaagtctcgctgtgattttcagcttgaatgctgaccgcggttattactgagtgacttcggcctgaaagcctccgcagcatagaagcagcttcttcttgatcctgcggtttgccaagacattcgccgtcaaggcataccattgtatcagcaccgataacgattgcatgcgggtggagatcagctacagccttagctttttgttttgccaaccattggacgttttcttctggtgaaaagtttcgatttaatttttcttctacttcactgacaataatggagtagggcagctgtagaagatcgaggagttctttcctgcgcggagattgtgatgccagtattagcggttttgtcatgttcgtcatcctttcagggtttgcttaagaaaaaaagatactcgtttatcctaccaaatcacgaggcttgtcacaatttcagaaaaataactttttcatgacaaaataaaaaaagcctgtcactaaaggacgaaggctcagggcactatctcttattttacgacggctaacagctcctgctgagccttccacccggcttcagcacttggatcctctaattcctttaaagcctgcaaaatcgcttttttctctcctgtttctgacgcttttgtttcaccaagcgacttttctattttctctacactcgcttttgtaatgtcttcgccgagaatcgcctttgctgcaagctccgctgtttccttaaaagaatctgtcatatctgactctattgataaggaaagctccttgcctccccaggcttcaaaatcactgtcgattaaaacctgtcctaactgctgtgagacatccttatcactggctaagcccgcgatgacatacgtatacccgtcatcctttgacagtgacacggcggaatatcctttttcggtcaattgttctgttaacgtttcggcgcccttttcatttgaaaattttccggcttgcacagcgtatgttttgtatgtaccttcagtttgtgcttgtttttctgcgtctgaggtttgtttatcagcagaagtatcccctgcttttgccgtttggctgcctagagaatcctctaaagaggccggtgctgacgcttctttattccccgatatgtttaacgcgaataaccctaatccagtgccaatgacagccgcgaaggcaatcgtcgcagccactctttttactggtttggcagtcccggtctttccttttgcataagactttgtttttttcttttgataaggaggaacaactttagggtcctctttaaacaccttgtccccctcggaatcccaattgaattcatcttcatcagggtgttcctgggatgccgcaacctcttgttctgcctgtcttttttcctcccaatttgaaaatgtcatgcttctatctgcctctgtatcaggtgtctcttgttcgtaaaccgtctcttcttttccattaatcgtcaccttgagggctttttctgcggctttactgttttttttattctttctttttttcaattccgcttcctcccttcatttgcttgaccgttcttgtcggcttttcatgctacacactttagcacaggcaaagaaaaaaagaacaagacttttgtcgccttgtccaaaaaacgttcgtcaaatttttcagcagtcagcccaatgccattttgatataaaaagaaatgatagagtcaccgtataaataggctaaaatgctccctgcggccatagcgggggcgaagggaagcggctgccttttagcgagtctaccagtcagaacagctgccgctccatataatgcacctatcaaaactgaaaagaaaaaggcagctgccagcattttcacaccaagcacaaagccaatcaccgcaaataatttaatatctcctccccctactcccccatgggtgattgcggcaattacagccagaaatagaaatccggctgccgcacctagcaggcctgcataccaggaatcaagcggagaaatcaatctcgcggccgccaaaaagggaagaaagaaaatcaatattcgatttggaatcagcataaaatgaatatctgtcactgcaacaataatgagaagagagataaacaccacagcgggaaacagttccagcgatgtgccaaagcgtattcctgcggcagcaaataaacacgctgtcacaagctctgctgcgggatacataaaagaaatcctatgcccgcagcttttacatttacctttttgaaataggaatgacaggatgggaattaattctgcaggagttaatgtccgccggcaaaacgggcatgatgaacggggcgcaataatagatagatgtaaggggatacggcacccggccgtatagtaaaaagaaccaaggatcagcccaaagataaaaagaatggatagcatagacaacacacctttactcattgagttctggtatggattgtagcaaaatggacatcctgagctccaattgggaatattcaattttacacataaaaaaacggcagaatcttttttttgattctgccgagccggatgcttttatttcaacctttttcgaatgtcagaaataaagtaaagagatccggtaatcagcacaatttcatttgagccctttttgctttctatgaatttgatcacatcgtctggatcttcactccagcttttattgctgatttcacttgcatcatagagatcttttgcaagagaagcacgcgggaaatcaaaagaagcaaaatgcatcgcatgagcaatggtttccagtcttttaatcatgttctgatacggtttgtcctttaacgcgctaaacaccacagaaatgcgtgaattggcgaaacgctgcttcatcgtttccgccagcttttcaacaccttcttcgttatgcgcaccgtctaaatataccggaggatgctcctgaacaagctctaaccgtcccggccaagcagccttcacaagcccgctccttaacgcttcgtcactgatatgggcgatattctccttattgagccactccgcagccaaaatggacaaagcagcattttgtctttgatgggtgccaatcagagatgtccgaatatcttcatagcatttctcttccgttttgaatgaaaactgttctcctgcaggcagagcctcttcattgaaaataacacatgcatcatgcaatgactggaacggcgcagcatgccgttcggcttcatggcggatgacctgtaaagcttccggctgggtaactgctgtaacgattggaataccttctttaataataccggccttttctcctgcaatttcttcaatggtgtttcccaaaatattcatatgatcgtgtccaatgcttgtaatcacagttaagagcggttcaaccacattagtagaatcgaatctaccgcccaaacctgtttcaaaaataacaaaatcgaccttatgaaattctgcaaaatataaaaatgcacaggccgtcataatttcaaattctgtcggctgtccgtattccgtttgatcaagggcttcaacgtgcggtttcatttgattgacgagtgctgtccattcctcatctgaaatcggtatcccgtttacgctgatccgttcattaaacgtaataatataaggcgatgtaaatgttccaaccgtatatccggcttcctgcagcatagaacggataaaagcgacagttgatcctttaccgtttgttcctgcgacgtggaacgctcggatttttttttcaggatgtcctaaccgcgccatcagctgtttcattcggccaagtccgggcttcaccccgaatttcagcctcccgtgaatccagctgcgcgcatcttgatatgcagtaaacaatgataatcccctcttttataagacaaggcggtttctctagaaaccgccccggcttttcattaacccttcagctcagccattcgtttttgaacagcgtcacgcttcgccacataatctttttctttttcacgttcttcatcaattacgtgtgcaggcgcttttttcataaatccttcatttccaagtttcttttggacacgctcaacttcttttgtcagtttatcaaattctttttgcagacgggcaatttcttcatcaatattgattaagccttcaagcggaagaataacctctgctcctgagacaacggccgtcatcgccttatcaacagcctcaatatcggtgccgattttaagcacactcggattcgtaaagcgttcaacatatgaacggttcgcttcgaggcgggctgctatttcgtctgtgcttgttttaatgtacagttcaacctgcttgctcattggcgtattgacttcactgcggatattgcgcacagaacggatcagctcaacaagaagcttcatgtcagctgccgcttcagtatcggtatgctccggcactactacaggccattgacttactgtaatcgattccccttggtgaggaaggtgctgccaaatttcctccgttaagaatggcataaacggatggagcagacgcatcgtttgatcaagtacgtaagcaaggatggaacgggtagttttcttagccgcttcgtcttctccataaagcggaagcttcgccatttcaatataccaatcacagaaatcatcccaaataaagttatataaatggcgtcctacttcaccaaattcatatcgatcagcaagctgggtcacgtgctcgatcgtttcatttaatcgcgttaaaatccacttgtcagcgactgacttttcgcctgagagatcaagctcatcgtacgtcataccatccatattcattaatgcaaaacgggaagcgttccaaattttattggcaaaattccaggtcgattccactttttcatagctgaagcgcagatcctggccaggagagcttccagtcgcaaggaaataacgcagagaatcggctccgtacttgtcaatcacatccatcgggtcgacaccgttgccaagagatttactcattttccggccttgctcgtcacggattaagccgtggattaaaacatctttgaacgggcgctcgcctgtaaattcaatgccttggaaaatcatgcgtgatacccagaagaaaatgatatcgtaccctgtcacgagaacatctgtcggatagtagcgtttaaagtcttcagcagttacatcaggccagcccattgtggagaaaggccatagcgcagaactgaaccatgtatccagtacgtctgtatcctgttcccaattttcgctgtcttccggcgcttcaagcccgacatatagctcgcctgtttctttatgataccaggcaggaatacgatggccccaccacaattgacgggagatacaccagtcgcggatgttttccatccagtgtaaatacgttttttcgaaacggtcaggcacaaagttgaccttttcttctttcttttgcagctcaatcgctgcatcagcaagcggctgcatgcgcacaaaccattgtgtagaaagataaggctccacaacagccccgcttcgttcactatggccgacagagtgcatatgatcctcgatcttgaagagaactcccgcctcctgtaaatctttcacgagctttttgcggcattcaaaacgatccataccttgatattggagcgcattttcattcatcgtgccatcttcattcatgacaaggatgcgttctaaattgtgtcggttgccaagctcgaagtcgttcggatcatgagcaggcgtaattttcacggcaccagacccaaattccatatcaacatagtcatcaccgacaatcggaatttcacgatttacaatcggcaggatcaccgtttttccgataaggtgtttatagcgctcgtcttcagggtgaacggcaacagctgtatcaccgagcattgtttcaggacgtgtcgtcgcaatttcaattgagcctgaaccgtcagcaagcggatagctcatatgatagaatgcgccttgaacatccttgtaaatcacctcaatgtcggatagggctgtttttgtcgctgggtcccagttaataatatattcgcctctgtagatcaggcctttttcataaagcttaacgaatacttctcttaccgctttgctcaagccttcatccagcgtaaaacgttcacgggaataatctaggccaagacctaatttcgcccactggctgcgaataaagtcagcatattcttccttccacttccacgtttcttcgaggaatttttcacggcctaaatcgtagcgggatttgccttcttcacgaagtttcgcctctactttagcctgtgtcgcgatgccggcgtggtccatgccaggaagccacagcacatcatagccctgcatacgtttcattcttgttacaatgtcttgcagcgttgtgtcccatgcgtggccaaggtgaagtcttcctgttacgtttggcggcgggatgacgacagagtatggctcttttgtctggtcactgcccgcttcaaaaaatttgccttttagccaaaaatcatatcggtctttttcaaccgctgccggatcatatttcgtcggcattgtttgttcattcgtttccatcataaccctccagcatgtttaaaaatggctgagaacgaaaaaagagctcttcatccctgtaaaaggacgaaaagctctttcgcggtaccaccttttttcatgaactctatcagttcatgcacttataacggataacgggtgtttcccgaatttctctactcttctttcaagaaattatgctcccgggcgaccttccaatcagacaacataagaagcctttcagcaaacggcttctctctctgcatgcgccttttttgtactcttcccgttctaagcaggtgtatttatcagctcattgtacattatttatgttctttattatagtaaaagtgtttttgattcgtcaatcatcttttccaaaaacaccgctttctatacagatgggcaggcacctattgcccaagtttacatatgatgcttgtaaatgcgtagaggaggatgcaccgtgaagaaacgtttcagctcttattcgctgccgccatgggtaaggcaaattcggcttgtatccgcacaagtgattattcccattacgatttttcaaggaatcagaaccattttctttccgacaacctttgatgttttgctgctcgcaatcctaatctttttagcttgcgcccttcatttagaatggatataaacaaacaagtccgcgccattaagacgtggactcgttttcagcctgaaattttttctcttgttcaatctgatgaattttcatcacaaacggctctatatttttcatttgccaataagcctttaataattgtgtacattcctctttttcatgctgtcgtttcccagtttgataaccgttcagcaccttgtacatggctgccggatatgccatatagctgagaaaaaggctgacttccgcttcacgcaaagggaatgatttcgtatatccataaaaccattcgacgcattccggacaagctttcggaaagcctctgaacatttttgtataaaagccgagcaggtcgttttgcggaggaccgacagatgctctttcgaagtttgtaaaatatccggtcccagcatcattatacagaaaatggtgtatagacaggctgccatggttcattacaacccttgaaacgtccttttcctttgcagactcataccagtcctccagccgttccagcgcaaagttcaccgcggaaatggtttctgaaaaataggttatggcctggagttcaaaaggagaaaggtaccattccttctccgctctatccacaaactgctcatagaaaattttatcttgttcccacttttttttcgtttgcccgtaataacgttcaatctcatcacgtctaacctttagttcctgcgcggttctctcgtgaagacgggctgtttctctaaataaataagcatgtttctgatcccgttcttcctcttggtcaaattggagccaaggcattaaatagtaggtatctccgtattgtatgcctgctgagaaaaactcaccgctatttgttctgtaaacgggaacgaatgaacgaaagcctttttcctcaatcgccaccatatgatctgtaaaatgcttgccgcgaccttctttcaattttttcagggcaaatatgccgtagtctgtatacactttccaaacaagaggactgacaggctcaataaattgagcagtcagtccgtattcctgaagaaccgattgggtatcttccatttcattcaccacattttccgatcacttacggtttacgcatggctatttttatattgaggaatatagagaatctgtcctgcttttaattcatcatccaatgctaaagaattcatcctgatcagctgctgggatgtaatttcataccgttcgcataaacgctcgatcgtatcttcctgctgcacaatacaaattttcattctcgaaaactcatccgcttcttttgtaaagagttttgttaaataaagagaattatcactttcctttgtttgaggttccttcgtttcagcagcaggagcaaccctaggaacagcatccgtttccttcctttcagtctcagaagattcaggcagctggaaggattgaaaaggtgtttcttccttaggctcttcaggtgatggtgtttttctcacttcaatttcgaagctctcttcctcttgttcttcctcctccagcagcttaggcgctgaataaaaagaatcctcctcttcttgttcagacaggaaggtacggtatgccggttcaggcaattcttcttgagatgcctcctccgagcttgttttttgattgaaatggaaatgtaaatcggctttgtcattctccacatatgcagctgaagctgtttctctgctatcttctatggagagagcagcctctgatacactctccaaagcttcatccgcttccgcctcttcttggcaaagcgcaggatcagcctgatccgattgagctgcttcttcattttgagcctcttggcgcagcgcatattcatgattaggagacactgttgtttcctctttttcctttgcaatcacagtctctgaatgaagctcagcttccaaagcaggcgattcttctgctccagcgtgttcacgaggctcagtctctgctggagagtctgcttcttcacgaacatccgctattgcagctgccggctctgccgtttctttttttgctttaacgatctcttgaatctctatttctgaaggatcaggttctggctcagattcttctgtttccgattcagcacgaacctccttttccgcagcaagctcttctgactcttcttcctctttcacatcttctctggcctctggatctgaagcaaccgattcaggcggctcagattctgctttttctgtctccagttcttcacggagccccgctttcgagataaaaagttctggcggttcggctggcggttcatgctgaagaactgcttcctctgccgatgatgcacccggttcttctactacactatgtgccggcggctctgaaagctcttcctccctgaatgccgcaggagcttcatataaaggtatctccggctctttgtcttgcgtatcgtccaaaagcccttcgatcgctaaatcagcttgaattgttaaaatgcgcgaatccgtcaattgatagtcaaatgcgtcaataaagacgaagacatcctgtaaatggctcactttatttttcggaatggtaatatccacaggaaaacagtgagtcagttccgcacttccatcctctctctttctgacttgttcaacaaaccgcttatctgtataaatctcttcggtatgtttgttttgatctatgttgtactcacctgtaagttcaagcgatcctatgattgatacataatcatttacttcctgaaccctaatatcaggatctaatgaaatagaaagcagttcagaaacttcctgtcctttttggaaacagatcgattcttctacagaaaattgcaatcgatgattttgtggcaagttcatatcctcctttcatctaatccttaaaattagatgtcactaaaggtgtatgtatgaactggagaaaatatgagtgggagagcacgaaaaaaccggcacaaggagtccttgataccggttttcactcttatctgcggctgatctcagcaaatactttctcagctgcctggattgtgttttcaatatcttcatcagtatgggccgttgagaggaaaagaccttcgaattgtgatggcggaaggaataccccttcatttgccatccctttataatagcttgcgaacagcttcaaatcagatgatttcgctgtttcataattgatgactggttcgtttgtaaagaagaaaccgatcatcgaacctgcacggttaaaggtatgcggaatgccatgagcctcggcggcttttgaaattccttcttccagcctgtcgccttttttgatgaaattcttgtaggaatcaggtgtcagctgtttcaatgtctctaagccagccgtcatcgcaagcgggttgcctgacaatgtaccagcttgatagatcgggccgcttggagcgatctgctccatgatttctgcctttccgccataagcgccgacaggaagtccgcccccgattacttttcctaaacaagtcagatcaggcgttacgccgaagtagccttgagcgcagttataatcgacccggaagccagtcatcacttcatcaaaaatcagcagggagccgtactgctcagtgatatcacgcagaccctgcaggaaaccttcttgcggcggaacaacacccatatttccggcaactggctctacaatgactcccgcaatgtcttcaccgaattgctggaaagcaagctttacactgtctaaatcattgtacggaacggtgatggtgtttttcgcaatgccttcaggcacccccgggctgtcaggcagaccgagagtggcaacacctgaaccagctttaatcaagagagaatcgccgtgtccgtggtagcagccctcaaattttaaaatcttgttgcggcccgtatagccccttgccaaacggagggcactcattgtagcctctgttccggagcttaccattcggacgatttctacagatggcacacgatcaatgacgagcttagcaagttcattttctacttcagtcggagcaccgaagcttgtcccgtattcagccactgttttgaggctttctacgacgcggtcatttgtatgccctaaaattaaaggcccccatgacaagacgtagtcaatatattcattcccgtcaatatcaaagattttcgagccttttccgcgctccataaaaatcgggtccatgtctaccgatttaaatgcgcgaacgggactgttcacaccgcccggcatgagtttttgcgcttctttaaaagccgtttttgatttttcatagcttctcatctgcctcaactcctgtcaactgaataaaattactccgcaagccatttcgctgcgtctttcgcatgatacgtaataatcaggtcggcacccgcgcgcttcatgcttgtcaaaatttccaacacaatttctttttctttgatccagccgttctgcgctgcagccttcaccattgaatactctccgcttacattataagcgacgagcggcaaagtaaactcattttttacgtcacgcatgatatccatataagaaagcgaaggtttgacaatcaaaaagtccgcgccttcctcgacatctgattgtgcttcgcggagtgcctccatacggttggcagggtccatctgatatgttttgcggtctccgaattgcggtgtgctgtttgctgcatcacggaacggaccgtaaaactcacttgaatatttaacagcgtaagacatgatgggaatattgacgaatccttctttatcaagtgcttctctgatcactgtaacaaatccgtccatcatgtttgatggcgcaatgatatccgcacctgctttcgcttggctgacagctgtctgcgccaaaagttccagcgattcatcattgaggatgaccccgtctttgacaagtccgcaatggccgtggtctgtatattcgcacaggcacgtgtcagcgacaacaaccatttcagggaagtgttctttaatttctgtgatggctttttggacaattccgtgatcatggtacgcttgtgttccgcaatcatctttttcttccgggatgccgaacacgataacagattgaatgcccagtttgaccagctccgctacttcatccttcaataaatctaatgatacatggtaaacatcaggcattgacggaacagcttttttgccttccagcccttcaacgacaaaaatcggataaataaaatctgatggatgcaaacgtgtttcctttaccatttctctcattgcttttgatgtccgcaggcggcgatgtctattaaatgattgactcatattctctcttcctctcttgacatgctgcacattaattcaagcatgccatctattgtaaatgtatcaggcgtatgcgatgtgatgccgtacgtcagaagggcatcatttgttaaaggcccaatgctgatacaggccgtcccattcgccttccacttttttaattcttctcccaagacatgcataaacgtatgtacggttgatgaactcgtaaatgttacatagtcaaaggaatattgacccgcagcgtctttcagtgcctcaatgccttcttcatccggaatcgtttcgtagagaacccattcctttacttcaaaaccgagcgggacaagctcttgttttatcacatcacgtgacaaattccctttcatcacggtaatgggctcccccggttcagcatgctgcttaagagcgtcagccaattgttcagcaatatactcctgtggcatcacatcaaccgatacgttatgcgtttttaaacggcgggcggttttttcaccgacggctgcaatttttttatgcgcagggagaataagctgattttccttcagataagaaaaaaagaagtctgccccgttcacacttgtaaaaacaagccagcctggcgcggcaagatcctctcttacctgttccgcaacatcattcggcaaagcgcggcgaaacgtaatcaaagaggttaaaaccgctttaccgccaagcgcctccactttttgctgaaatgatgttgcctgtgccttattccgggtaacaagcactgtttttcctttcaacggaaaatcattttccatcctcatcaagctcccgttttacacgatcaattaaatcttttgctcctttgtcagccataagagcggcacagcgctttcctacttcctccggatcgtttccggtgacggtttctttaaaaatgattttgccgtcaggtgaagcgacaagacctgtcatttcaatttcatcctgtccatttaacacggagtagcctgcgatcggaacctggcagccgccctccatcgcgtttaaaaaagcacgttccgctaagacagtccgttttgtatattcatctgtaaactgagaaaacaacgccaacagctcttcatccgattctcggcactcaatcgccagtgctccctgccccacagcaggcaaacagcgctcaggctcaaggaattcggttacgacatcttgcttccaacccattctagaaaggccggcagccgctaaaataattgcgtcataatcctctgtttccagcttttgaagtcttgtatctatattacctctaatccatttaattgtaaggtcagggcgctcaatcaaaagctgcgcgcttcttcttaaactgcttgtgccaacgacagcaccttccttcatttctgaaagctttacgcgattctttgaaataagggcatcacgcgggtcctcccgttcaggaatacagccgatcacaagaccttcaggcaaaacagcaggcatgtccttcatgctgtgcactgccatatcaatctcttcgtttaaaagcgcctgttcaatttctttgacaaacagcccttttccacccacttttgagagtgtaacatctacaatccggtcgccctttgtcacgatctctttaatttcaaaagcaaacgaaggattgatttccttcagtttttgaataacccattttgtttgagtcatagcgagtttgctccgtctggaacctactttaatcgttctcatcatttctttcctcccgaatctgcttgggacatcgtttaactgaaccaatggaattgcgacaggcttccaagcaggaaataattgatcatcagcaccagaaaacaagccgtattccacagtgctgcgacctttccttgcagctctttaatcagcctgatataaagataatagctgtacagcagcaggacgacaaacgaaccaagcactttggcgtcaaaccaatacagcgtttctagtgagacatacgcccaaatgacgccgagaatcaaactcagcagcagcatcggaaccccaatgacatttaaaacatacgccatataatcaagcttagataaatcttctattctcaacagccattttccccactttttctttttcagcagatgatattgaaacatatatagcacagaaaaaacgaaagaaagggaaaaagcgccgtatgaaagaatcgccattgtaatatgaatcaccaaaagctcggatacaagctgcccggaaaaagcagctgactgctgctctgtcggtgaaaatgtgtgaatggcgatcatagaaaatcctataacatttgtaaaaaacacgataaagtcaacacgtaaaagctttgtcagtacaagtgacagcgtgacaagcacccaggcataaaaataaagcgcctccgtcacatttaataccggaaaccgccccgtcacccacataaaataggccaaatacacggtttgcagagtccagacaatagaaagcaaccagaaggccatttttccagccttccggttgtgttgaagaaaatctataaaataaaagagtacacttaacgcgtaaatgacgattgtcccctcattaagtcttgccattgcagtatcaatcattcagctttcactcacttacaagtgggctaaagcccgcttttgattcagccttcttaaaagagtggaccttctggctgctttccacggttttcatcatttgacggcccgcagcttcttcaatatcaaaaatctgcataaacaacgcgagcttttcttcagaatcagcatctgccgcaagctctttcacctttaaaatcggatcacgaagcatttggttaataatacttttggtgtgtttgttcaacagttttttctctcttgtgcttaagtgaggcagcttacgctcaatgctgtccatcgtttctgactggatagcaagcgccttttcgcgcaatgcagaaataaccggcacaacaccaagtgtattcatccattgtttaaattccacaatggtttcttcaattaacagttcaactttttcagctgtttctctccgctctttcatgttcgcttctacaatgccttccagatcgtcgatatcataaagaaaaacaccttcaagatcattcagcgccggatcaagatctctaggcacggcaatgtcgaccataaacagcggacgtcccttgcgaagcttattcgcgttttccatcatctctttggacacgacaaattcacttgcaccggttgaactgattaaaatatcagcctccgcaagcgcgctttcaagctgattcaagcttctcgcttcacctgagaaacggtctgcaagctccttcgctttcaagtatgttcggttaatgacagtgaccttgccgattccctgtccgtgcaggttttccgcagcaagctcgcccatttttcccgcaccgagaatcaatatgtgcttgcttgaaagatttccgaagatttttttagcaagttcaactgcagcatagcttactgacaccgcatttgagccaatgtctgtttcggcgtgagtccgtttgcccactgtaaccgcctgcttaaacagctcattaaaaatagtcccgatcgttttttcttgctgagctgttttaaagctgtcgcgtacctgtccgagaatctgcgtttcgccaatcaccatagaatcaagtccgcaggctacacggaataaatgctcaacagcggcatcgctctcataaaacgttaagaacggtgacagctcttctttgcttaattgaaaccaatcagctaaaaacttttttatataataacggccggtatggagctggtcgactaccgcataaatttcagtgcggttgcaggttgagacaatgatgttttcaagaatgcttttctcttctttcagctgcaccattgcttctgccagctcattcggctgaaaacttactttttcacgtatctcaataggggcggatttataatctactcccacaacaagtatatgcatcgctctaattacacccccaacgcccaatcttaatttataatcattctaacatagaactcattatttataataattataacatagtttctttcacaaaatgtgaacagattttaaaattcttatgctatattagaaaaagcttcagggaaaagaagcattcctattgacaataccaaaaacagcagaaatttactacacatcagctctaaaaaacaagaaggtgatatgcatgaaacaaaaatcaattttattcccttgcctgctgcttgccgcttctgtatatgcatggcttgaaagcggccaagctgaactgttttcgggacaggatcaatggcctgttctcctcatgctgttaggagcagcctttgtatatcaaggaaaaaaagaagccgttgcaccccatttctttatcggtttgcttctcttcgggatcggtttacacttttttgccaagccgaaatgggtatggtggccggatgattttgaaatgcttctctttatgatcggcttctcactactcgtttcaaccgttcaaaaaaaagaatatgtatatgaagctgtgtcgatgatttgtttttccctgtttttgtactttttcaaacaaattatggcatggcttgagtctgcgcatattccaacagcgcttctgaaggagtattggccgtttgtctttattggaatcagtttattgttattattgataaaacgaaaaaaatctatacgataaataaaaccggtagaggatcctctaccggtttatcatttttttgatcgctccccaagcttcgtcttttccctttttcgtttctgaggaaaagagaatcagctcgtcttccggatcaatatttaatgtttgtcggacaaccttcgcgtgtttgtcccatttgcctttcgggatcttatccgcctttgtagcgataacaataacaggaatgccgtaatactttaagaattcatacatctgtacatcatcattagatggcgcatgccgcaaatcaacgatctgcaccacagcttttaattcctcgcgtgtcgtgatataggtttcaatcattctcccccatgcttcacgctcagactttgacactttggcaaaaccgtagcccggcacatccacaaaatgcaactcatcattgataatgtagaaattaagtgtttgtgtttttcccggctttgatgacgttctcgcaagatttttgcgattgattaatgaattgataaaagacgattttcctacgttcgatcttccggccaatgcgatttccggaagccccccttcagggtactgttccggttttactgcactgatcacgatttctgactttgtgactttcatttcttctctcctactaaggcatgttccaaaacctcgtctaagtgggacgccaatataaatgtcagcccctccctgacgctttccggaatatcctctatatctttttcattatctttaggcgcaataatggtcgttaatcccgctctatgtgcgccaagcgctttttcctttaagccgccgatcggcagcacgcgcccgcgaagcgtgatttccccagtcatgccgacttcacgcgaaaccgcccgtcccgttaaagcagaaacaagcgctgttgccatcgtaataccggctgacggaccatcttttggcaccgcaccctctggtacatgtatatgaatatcatacttctcatgaaagtcaggttcaatgccaagttcttctgttttggatcgcacatagctgaatgcagcctgagcagactctctcataacatctccgagctttcctgtcaggattaatttccctttccccggagaaagcgatacttcaatcgacagcgtatctccgccaacggttgtataagcaagccctgtcactacaccaacctgatcctctgtctcagcttgtccatatctgaaaatacgttttccgataaagtcttgaaggttcttctcagtaaccgtaatccgttttcgctcttcagcaacaatggcttttgcagctttacggcaaatcgcggcaagctggcgttcaaggcttctcacaccagcttctctcgtatagtagcggataatatcaagaatcgcctgatcacgcagctgcaggttgcttttcttcagcccgtgttctttgatttgctttggaagcaagtgatcctttacgatttcaagtttttctatttctgtgtagcctgcgatattaataatttccattctgtctctgagcgggcccgggattgtggccaaattgttcgccgttgcgataaacagcactttggataaatcaaaggtttcttcaatatagtgatcactgaagctgctgttttgctctggatcaagcacttcaagcatagcggatgatgggtctcctctaaaatcagatgacattttgtcaatttcgtctaataagaagaccggattcagcttgcccgcttttttcatcccttgaataatacgtccaggcattgctccgacataggtccgtctgtgtccgcgtatctctgattcatcccgtactcctccgagtgagattctgacgaatttgcgtcccaagctttttgcaattgatttggctaaagacgtttttccgacacctggaggtcctgccaaacagagaatcgggcctttcagggatttggtcagcttctggacagccaaatattctaaaatacgttcttttactttttcaagcccgtggtgctcttcgtccaagagacgtcctgcttctttcaaatcaagcttatcatctgtttcatccgtccacggaagagcaaccagccagtcgatatagttgcggatcacagagctttccgcagaacttgacggaattttttcatatctgttcaattctttaagcgctgtttctttcacatgatcaggcatgcctgcttcttcgattttttccgtcagcgtctgaacttcgccagttttgccttctttatcgccaagctctttttggatcgccttcatttgttcacgcaagtagtattccttctgcgtacgctccatcgaacgtttgacgcgctgaccgatttttttctcaatctccagcacttctttttcattattaataaaatcaatgaccttgttcagcctgtctttgacatcagccgtttctaaaatatcctgcttatcctttagtttaaggggcagatgagaagcaacgatgtctgccattctccccggctcttcgatatcagtaaccgcagcgtacgtttcggccgagatttttttagaaatttttatgtactgatcaaagtggtctagcaaagtccgcatcaatgcttcgtcttctgtatcttttgaatcatcttcatgaataagttgaatgtcaaccgacgtgtaatcctcgtgttcattgtatttgacgatatgggcgcgcttgaggccctccaccaacacacgaatcgtaccgttcggaagcttcagcatttgcttaatttttgtataggtgccgacagtgaaaatctcgtcttcaccaggttcgtctatcgaaatatcctgctgagtggctaaaaatatcatatgatcatgcatcattgcctgttcaagagcctgaaccgacttgtcacgtcctacatctaaatgcaaaaccatcgtcgggtacactaataaacctcttaaagggaggagcgggatgctgcgttttaattcttctgccatgtgactgacacctccgtgactttagtatgaaccattataatacaactttttcatccttgtacaataaacggcatggttccattttctataaaacagtctcctcgtagtataccctttctttctgatatgaaaaaggaaaagatgtccttcatgaaaaaaaccctattatcaaaatagggtttaaacggattctttattgatttcgatatgaaacggtttttgttccgttggcggattcaccaaaatttcatcaagcacttcttggaacgtcttcactgcaataatctcgatcccgtcaatctgctttaagatggcctgctgattttcatatgggataatcacctttttcgcaccggactgcttggccgcttttattttcggaatgacgcctccgatgggtttcacaagaccgttcaggctgatttcgcccgtcatcgcaacggtattgtcaataggaattttgtgtatcgccgagaaaatccccgccgccatcgcaatgcctgctgacggcccatcaatcggaatccctcctgggaaattgatgtgaatatcataatcagaaggcttcattcccattgtccggagcacggttaatacattttcaaccgaacccttcgccatgctttttcgcctgatcgattttgattggctgccgatgctttcttcttcagctattcctgtgatgttaattgatcctttatcttgagccgcggttacacttacttcgatttccagaagcgatccgctgttaggcccatagactgcaagcccatttacaatgccaacctgtggttcaacaccgattttttgctcgtgctttggagtaagctgactggagtgaatgacccattcaatatcctcaatcgtaatgtcctttcgattctccgttacagccatccccgctgcgatttgaatcatattgacggcttcccgcccgttccgcgtgtagctggtcaaaagatccagtccttcttcggagataattttttcaattttatccgctgctgttttggcaaccgttttcaactcgtccttttcaagctcgcggaaaaaaacctccaaacagcgggaccggatagctggcggaatttcgtttggcattctcgtggtcgcgccaatcaagcgaaaatcagccggcagcccattttgaaaaatatcatgaatatgattcggaatttgtgtattttcctcactgtaatacgcactatctaaaaagacttttctgtcctcaagcaccttcagcattttattcatttgaataggatgcagctcccctatttcatcaataaacagcacaccgccatgggcatgggtgacagctccctgcttcggctgcggaatcccagcctgtcccatcgctccggccccttggtatatcgggtcatggacagagccgatgagtggatcggcaattcctctttcatcaaaacgggctgttgtcgcatcgagttccacaaagacagcctgctctttaaacggtgattgtttatgtttttttgcttcttccaacacaagccgcgcagcagccgttttcccaactcccggtggcccatagacaatcacatgctgaggatttggcccgcataaagccgcctttaatgctttaatgccgtcttcctgtccgacgatatctttaaagcttttggggcggaccttctcagataatggctcggacaagctgatagcgcgcattttccgaagctgctccatttccttctttgattctttatctatcgtgaccttttgtgtcctttgatttttaagcaaattccaaaaatacaaaccgatgatgatcccaaaaaacagctgaataaataacgcgatccctgtccaactcatggtggtccctcctgaaaaacaatttatgtatccaattcattcctctgattgctagtatctcccatagaagacgggaataaacgtttttccggaagagttgcatgcaaaaaaacctcctgagtgttaccactcaggaggtttgtgcttatctttatgcagatgttttatcttggcttacctcagtgccgtcttttaataagaggcgaggaggctctccgtgtgtcacagttgccccggtgattacacatttttcaatgtcatcacgagaaggcagctcaaacatcacatcaagcatgatgccttcaatgatggaacggagtccgcgtgctccagtcttgcgttcaattgcttttttagcaatttcagaaagcgcttcttcttcaaactcaagctcaacgttgtcaagctcaagcattttcttgaattgcttaactagagcgtttttcggttttgttaagatcgcaaccaatgcttcttcgtcaagcttttcaaggcttgcaataaccggaagacgtccgataaattcaggaattaacccgaaacggagcaaatcttcaggaagcacttttgaaagaagatcttctttctcaagatcagcagctttattgtcggcaccgaatccaatcactttttggcctaaacggcgtttgatgatttgttcgataccatcgaaagctccgccgcaaatgaacaaaatatttgttgtgtcaatttgaatgaattcttgatgaggatgcttacgtcccccttgaggcggcacgcttgccactgtaccctcaagaattttaagcaatgcctgctgtacaccctcacctgacacatcacgtgtgatagacgggttttcagattttctagccactttatcgatttcatcaatatagataatgcctttttcggctttttccacatcataatcagcagcttggatgagcttcaagagaatattctctacatcttcacccacgtatccagcttcagtcaaagatgtagcgtctgcaattgcaaacggcacatttaaaatgcgagccaatgtttgcgccagaagggttttaccgcttcccgtagggccgattaatgaaatattactttttgagagctcaacatcatcaactttgctgttagagttaatgcgcttatagtggttatacacagcaacagcaagtgatttcttcgcttgatcttggccgatgacatattcattcaaaatttcgcgaatttcctgaggctttggtacgtctttaaattctacttcttcttctgttccgagttcttcctctacaatttcagtgcagagttcgatacattcgtcacatatatatacaccaggtccagctacaagcttacgaacctgatcttgtgtttttccacagaacgagcattttaattgtcctttttcctcgttaaatttaaacattctttcaccccttaatcttgtctcactttttcttttaccggcagagcaaaagaaaatgattcttgaaacgaacgagtatgtattgcattttaccatactttccaaaaagacggtaacaatgtgtttctgacttgcacattctatatgtatgacaaaaaacagccctgcattaactatattgccccaagaaaaagagataactcataattgtacaaaacaaggcacgaatgattcgcgccctgttttattagtactattattatgcaccatattaacggttttctacaagaaaatcaattgctttgcgaacttttaaatcttctttcatcgcgtcagtagaaccgatggcttgtttaatattttcaacaggcatgttgtatgcttcagccattttagtaagctcagcatcaacttcctcatctgatacttcaaggttttccgctttcgcaatcgcctcaagagtcaggttagattttacgcgtttttcagcatcttctttcatttgctctttaagcgcagcttcatcttggcctgagaattgagtgtaaagctcaaggttcatgccttgcatttgcagacgctgttcgaattctttcagcatgcggtcaagctcagtgtcgaccattgcttgcggaacatcgatttcagcattttcagaagctttcagaacaagctcttcacgcaatttagcgtcagcttcgttttcttttgcttcttctaaacgtttctttgttttttcagttaattcagcaagtgtttccacttcttcatcgatatcttttgcgaattcatcgtcaagctcaggaagctctttcgctttgatttcgtgaattttcactttaaacacagctggtttgcctgcaagatcttcagcgtggtactcctcagggaatgtcacttcaacatccttctcagcacctgcttcaaggccaactaattgatcttcgaagccagggatgaatgagccagaacctacttctagagagtagttttcagcttttccgccttcgaaagcttcgccgtcaacgaatccttcgaaatcaagaacaactgtgtttccttcttcaacagcgccttcttcttttacaacaagctcagcttgacgctcttgaagggcttttagttcgttttgaacatcttcgtcagttacagttgtgtcgtctttttcaatgcccaggcctttgtattcgccaagcttcacttcaggttttactgttactttcgcagtgaagattaagctttcgcctttttcgattttttcaacatcgatttcaggacggtctacaggctcgattccagcttcttcaaccgctttagggtattctacaggaagaagaatatccaaagcatcttggtaaagagcttctacgccaaagcgctgttcgaataatccgcgaggaattttacctttacggaatccaggaattgaaacttgttttactacttttttaaatgcatcatcaagtgctgttttaaacgtttcagcatcaacttcaaccgttaaaacgccttcgttgccttcttgtttttcccattttacagacatgtgtttccctccaaaaatctattcaggttgtgtcggtcttccattctaaagcaatcattcggcttcgtccaacaaaaacaaagctgccaaagatcagaatcattatgtatagatgttaataatgaactgcaaagcctgtccaaccgtatttcttataacccgttatacacaaatacaaccactatattataacataacacatagcgctttcaactatatggcgcgatttacaaataagaaatttcttcaatatcttttaacattgtgcaagcttcatcgagttctctgtcggtaaattcatacatcatatgaagttcttctctttcaatttcaattccgtgcatctcgtaaccgactttatgcagggcagccgcccaaaggtcagccgacagcaatttcggctggaacggatataaaacgtacaaatgtcttctccacaattcttctactgccgcgtataaggttggattttcatttccaagtgtttcatccagcaccctgagaacacggtgcagaatcggcgcggcatcaggcggaacaatctcagacggttcaattgtcaacgactcgccaaatttactaatgtgtacaggtttactgtactcatgctcagctaacagcatgacaatcatcgttttgataatcggatgggctgaggggtcttggaggattgttttgagcaatcctgtatactttgctacgttacggtcttttaaggaatggatgagattcatttgctcctcagggcttgccagcactttctcggtgtcaattgtatcctcatattcttcggcccaagcctcgtcctcacgatctggatcggtcattttccggctgaaatccagcagcttataaaattgctcggcgctttctgccggcagctgattttcttccaaaacggcttcaatggtgcttttgacttcttcgtattttttgagctgaattaagatggtcatgtacacctgcaaaaccgtaaaataatggccataaccttctttgagcatcttctcgcacacgctttctgcctcttccagctcgcccagctctaaaaagcagatggccatccctaagtgaagatcggattcagtatcatcatatttcatcgcttctgaaaacagttcaagcgcttcttgatactttttttccttgagtgatgacatccctttttccacaaggcggtctttcagatgaggaaaaggaataatttttgcgtttttcttgtcatgcgtcatacctatattcctttcaggcatttattttgttcaagtgtatcaacacctgtgaacaaacacaagaaatgaaaggtttcaccaggcaaaaaaagccgccggacaaataccggccgctttttcagtcttgaagccaagagcttctttgtgattcaaattgcttgatttcatcttccagcagcagcgttaatgaaatttcatcatatccgttgatcagcatctctttccaatgcgggtcaacttcaaatgaaatttgattgccttcactgtcatgaatcagctgattttcaaggtcaacagtcatttgcaatgacttgttttcatactggccgacaagctgtttccaattgtcatatggcatgcggatcggaagcatgccgtttttaaagcagttctgatgaaaaatatcagcaaatgacggcgcaatgataattttaaacccataatcatcaagtgcccacggagcgtgttcacgcgatgacccgcagccgaagttttctcctgctattaaaatggaagctccttgataaacaggctggtttaattcaaattcagggttcggttcaccattcgcatcatatctccagtcaaagaatgcaaaacgcccgtagcctgttctttcaatcctcttcaaaaattgcttaggaataatctggtctgtatccacattgatccgatttaatacggctgctttccccgtatgtgatttcaaaggttccatctcgcgcactccttacacaactgttttttcctgataaaactttctgacatcaacgaagtgtccgtgaatggcagccatcgcagccattgccgggctgacgagatgtgttcttgcaccttttccttgtctgccctcgaagttgcggttagaggttgatgcacagcgctctccctcaggaacaacatcattattcatactcaaacacatgctgcagcctgactctctccattcaaatccagcttccaagaaaatctggtcaagcccttctttttcagcctgaagcttcacgctttgagatccgggcacgacgatggcccttacgctgtcagctaccttcttccctttgatcatatcagcagcctgtcgaaggtcagtcatgcgggaattcgtgcaggaaccgataaatacgtgctccactttaatgtcttcaattttttggtgaggagtcagtcccatatattcataagcgcgaatcgcttcttttttatcatcttctgcagaaaagctttccggcgcaggaacttcagaatcgacaggaagaaccattcccgggttaatgccccatgtcaccataggggaaattttgttgccgtcaaggaagatagatttatcataaacagcgcccgggtctgtgcgcagcgccctccattcctctacggccttgtcaaattcttcgccttttggcgtgtacttgcggtttttgcaatattcaaacgtcacctcgtcaggtgcaatcaaacctgctcttgctcctgcttcaattgacatgttacaaacagtcattcgttcatccatcgtcatatttctgaatacttccccagtgtattcaatgacgtagcctgtgccgaatttcacaccgtatttgccgatgacagaaaggatgacatcctttgccgttacccctttttgaagcgttccatctacgcgcacttcaagtgtttttggacgctgctgccaaagtgtctgtgtggaaaggacatgttcaacttcactcgtcccgattccaaatgcaagagcgccgaaagcgccatgtgttgatgtatgactgtcaccgcacacaatcgttttccctggaagcgttaagcccagttcagggccgacgacatggacaatcccttgatccacactgtgaagatcggcaaggcgcacgccaaattcctcacagtttctttcaagcgccgttacttggcgtttcgcaacttcatcctttatctcaaaacgattgacagtcgggatgttgtggtccattgtcgcaaatgtattttggggtcttctgacctttcttcccttttgtctcaaaccttcaaatgcctgaggagacgtcacctcatgaatgaggtgcaaatcaatatagagaagatccggctttccctcaccatgttttacaatatgctgatcccaaatcttttcgatgattgttcgaggcatcatcttttatttcctccctctacctagagctaagaccgcttaacgtaagctgtcacacattagaaattgtattttcactcatgattgctgccttaacttcctctgtaatggcctgagtgctgctgaactcttcaccccgtgccaaatcttttgttcttttcccagaagccaagactttgtttaccgcatcttctacagctttcgcttcctcttcaagcccgaaagatgttctcaaaagcattgccgctgacaatatggctgcgaacggatttgccatccctttaccggcaatatcaggcgcggagccatgaacaggttcaaacagatgaagaccagagcttgataggctggctgacgggagcattccgagcgagcctgtaagcatggacgcttcatcgcttaaaatatcaccgaacatattttcagtcaccacgacatcaaattgattcggtgcataaattagctgcatggccgcgttatccacaagcatgtgctcaagcttcacatcaggaaactcttgtgcaacgtcctcagccacttcacgccacagccggcttgattcaagaacattcgctttatctacagaggtcactttgccttttctggctgccgccattttgaagccctctctgatcactcgttcaatttccgttctcttataaaacagtgtatctactgcttcctgctcaccttcagtgtttacataacgtttgctcggctggccgaaatacaagccgcctgtgagctcacgaacgataacgaaatcaacattatctatatattcttttttcaaaggcgaagcgtcagaaaggctttcaaataccttcacaggccgcaaattcgcaaacaaatcaagctgttttctgatgctgagcagccctttttccggtctcagttccgaaggattttgatcccatttcggtccgccgacagcgccaagcaatatcgcgtctgcatttttacaagcagcaacggtttcctccgggagggggttatgatgttcatcaatagccgcccctccaatcaggccatattcaaattcaaattcatggttaaagcgttcggcaacacttttcagtacgtctgtcgctgattctaatacttcagggccgatcccgtctccgggcaatagagcaatacgtttcttcaagttaaccgttctcctttcttttatgatccgacagctgtgtggtttttcaatccgctcatattcgactggaaaaccaattgacggttgactgcgttcaaataggctttcgctgatgcttctaatacgtcttgcgctatgccccgacctgctgattcttttccgttcaccaaaactcttacatacacctgggcaaatgcatcttcgccttttctgttagactgaatgcggtagtctaagagctccacgtccttatcgatgcagcgctcaagcgtattgtagattgcttccacacttccagctccagttgcagcttcctgaataagctctgcgttttcttgatttttcaacgaaagagtagccgtagggacctgacttgttccgtaatgtacttgcagagaaagaaattcatacccaatcttgcgatctgttactttttcttctaaaataagagaaacaagatcctcatcagtgatttcttttttcttctcagtcaactctttgaacatcgtaaagaatttattaatctcttcactgtcaaattggaatcctaaagcagtcagccggtctttaaatgcgtggcgtccggaatgtttacctaggacaagcgcatctgcggttacgccgacaagctccggtgaaataatttcataagtcgatttttcctttaaaaagccgtcctgatggatgcctgattcatgagcaaatgcattatctccaacaaccgctttgttgcgcgggacagccatgcctgtcagtttgcttactaaatcacttgttctcttaatctcgttcagtgtaatacctgtttcgacttggtagaaatcttttctggtatgaagggctacagcaatttcctctaatgccgcgtttccggctctttcaccgatcccgttcacagcgcattcgatttgatcagcgccattttcaatcgcagcaagagagtttgcgactgccattcccaaatcatcatgacagtgggctgaaagctttgctttgtgaatgttcggaacgttttctttcatatatttaaagatatttccgtattccgccggggccaggtagccgacagtgtccggaagattgataacactggcgcctgcgtcaatcactttttcgacgatttctgctagaaacggcagttcagtgcggcaggcatcttcagctgaccattgcacaatcggaaaacgttcttttgcgtatttcaccatttcaaccgctctttcaatgacttgctcacgtgtcattttcagcttgtgcttcaaatgaatgtccgatgtggcgataaaaacatgaattctcgggtgagaaccttcttttaacgcttcccaagcagcatcaatatcaccttttacacaacgggccagaccagttactgaacaatttttaatggttcttgcgatttcctgaacagctaaaaagtcacctcgggacgaagcgggaaatcccgcttcaatgatatctgccccgagtctttcgagctgcttagctatggcaagtttctcctgtgtattcaagttcactccaggggactgttcaccatcacgaagcgtcgtatcgaaaaaattaattttgcgcaacggagaccaccgcttccttcttcttgccttgtttcacaaacggcatcatttcacgaagctttcttcccactacttcgatttgatgttcgttctcgcttgcattgatagcattgaaacgaggacggtttacttggttttcgacgatccactcttttgcgaatgtaccgttttggatatcttttaatacttctttcatagattcttttactttagcgtccacaacgcgaggacctgatacgaaatctccccactgtgctgtgtcagagattgaatatctcattcctgcaagtccttcttcgtacataaggtctacgattaatttcagctcatgaaggcactcgaagtatgcaagttcaggctgataacctgcttcagttaatgtttcaaatccggctttgacaagcgcgcttaatccgccgcaaagaactgcttgctcaccgaacaaatctgtttctgtttcttctttaaatgtcgtttctaatacgcccgctcttgcgccgccgattcctttagcataagcgagggctttgtctcttgcttctccagtcacatcttgatagattgcgaacaatgccggtacgccagctccttgctcatatgttcttcttaccaagtgtcccgggcctttaggggccactaagaatacatctacatccgccggaggaacaatttgatggaaatgcacgttaaatccatgagcaaatactaatgattttcctgctgtcaattcatctttgatttcagcttcgtatactttttgctgttgctcatccggaagcagaaccatgatgatttcggcttgggctgccgcttcttttactgaaaatactttatgtccgtcttcttgggcttgagtgaaagattttccttgtctaacaccgacgatcacgtctactccgctttctttaaggttcagggcatgtgcgtggccttgcgaaccgtacccgataaccgctactgtttttccagccaatacgttctctttgatatcaccgttataatatacttttaccattttaatctctcccttgttatgttttatacaatagatattgttttattggatgacgccttttgctgggttcccctcgcaaaagccgttgtacctgttctcgcgatttctttaatgccataaggttttaataactcaataagcgcttcaattttgttagattcacccgtcacctgaacaacgatgctgtctctgctgacatcaacgacagaggctctaaacggttctatgattccattaatctctgttctcgttgaaggtgcggagacaaccttgattaaggccagctccctctggacaatcgattgatttgtgatgtccgtgactttcagcacatcaatctgtttgttgagctgtttcgttaactgttcaacatcattttctccttcaacgtgaacgacgaaggtgattctggaaacgccggctgtttctgtgtgcccaactgtaatgctttcaatgttgtaatgcctttttgtgaatagaccggtgatccggtttaacaccccggagcggttcaccacagtcaatgtgataattcttttcaaggtttcacccccaccatttcatgcagccctttccccggagccaccatcgggaatactttttcttcgctggcaacccgcacatcaatgacaacaggttctcttgatgttaatgcctcttccagcttttcctttgcttccgcttctgatgaaattctgatgcctttaatgccgtatgcttcggacaatttgacgaagtcaggctgagaagcgaatttagattctgaataacgttcttcatagaaaatttcctgccactgtctgaccattccgagacaagcgttatttaaaatcactaccttgaccggaagatttaattcgcgaataacatcgagttcttggagcgtcatttggaatccgccgtctccgacaaccgcgacaacagtagcatctttttcggccagctgtgcgccgatcgccgccggaagaccgaatcccatcgttccaagtccgcctgacgtgacccatttatctgctttttggaacggataaaattgcgctgaccacatttgatgctggcctacatctgttgcgacaatggcctctccttttgtaaattgatgaatatattcaatcaatttctgaggtttaaaaccttcttcttcattatctacataccagagcggatactcttctttccattcagcgagctgttttttccattcgcttgaatcgctttgtttgccgtcttgtttgatcagctcctgcaggacaattttgctgtctccgactacaggaatctgtgttttcatgatttttccgatttcagctggatcaatatcgatgtgggctatctttgcgtttctggcaaagtgtttcaggtttcctgtgacacggtcatcaaaacgggcgccgatactgattaatagatcacattcatgaagggccatattggctgtataagtaccgtgcattcccgccatccctagaaaaagcggatggtcagccgggaagcctccgagccccaaaagggtgtgtgccacagggatttgctgctgttcggcataattttttaattcttctgacgcttttccgtgcagtacgcccgcacccgccaggatcaccggttttttcgcactgctcacggcttccacaagcttgcggatctgcaaataattcggctctgttgtcggctggtatcccgggagattcatctcatgatcgtagctgaattctccttcaattgttgctacatctttcggaatatcaatcaatacaggtccgggtcttccagttgttgcaatatggaacgcttctttaatgatgcgcggcagatcttccggctggcgaacctggtagctgtgttttgttactggcatcgtaatccctaaaatgtctgcttcctgaaatgcatcgctcccgattacagaggttgctacctgccctgtaaagacgactaacggcaatgaatcaatcatggcatcagcaaggcctgtaacaaggtttgtcgctcccggccctgacgtggcaatgacgacacccggttttccggagacccttgcgtatccctccgctgcatgaattgctccttgttcgtgacggggaaggatatgtaccaaccctgaattgtatagcttatcgtaaatcggaagcacagccccgcccggataaccgaagatcatttctactttctctttttttaatgattcaatcagcattaatgctccgctcatcgtctgtgtacattcggcagatgctgaatccacctgtacattagtccccattttagttcctccttttggattttcatcctttaaagatcatcttttcattagctatatagctgattattcaataaaaaaagcccttccgcccacaatcagccgcgcagtaactgcgatagctaaaaggggcgaaaaggcttttctttccgcggtaccacccttgtttacggcctgttaatcggccgtctcatggatatttctatccgctttagtaacgagtgaatcaagttcacccggccaagtcctactgtcatttcagactggcactctgaggcgagttcaccttgtaaagcttcgccggttctcagctaacccggttctctgtggaaagctttttcaaggctacttatcctcatctgcgcttttcatattcagccttcggaacggttttccagctgttcaagaaggtcgtttgtttttcactttttagaatcatactgcgatgattttcgcttgtgaagcttgcgtttatcttttgttgaactcatattacgccgctttggacgcagtgtcaacagcattttttaaaattattagacaattttgattaatcaatctatattgtatacgctttcattattggtacaaaaggaattgcaaatgttaaaagtttttataatttttttattaatctatcaagaataaaccagaattatttaattttatataaacatgtaagattttataacacgctatggttcgtatatggattgagtctgacagatcatcttgcaatccatttcaatttcggataggcacccctattattcctcggcatacattaatggtatcttgcaaagaaaaggtgatacgatgaataaatcatttgcagacatgcaaggatttcctgcgggctttccaagcttccccaactttccgcagcagtattatcctgctacccctgccttctaccagcaaagccagcagccatttggaggctacggatacggacagccgttcagtcaggcatacagcccgttaaccactccctctggaatgtactcctcattcccatacgcttcagggttttacggacagcaattttcaggtgcaggctttagcggccatggcggcagcttaagtgctccagcgatacatgccggcggattcagcggggcgccaggcgtacacggaggctttagatattaaagaagaccacaagggccgaacatctattgcggtccttttattgttttaaaacgacttcacaaatacagtcacattttctgtctttatatttggaaacaggatggaatatgattagatgaattgaacgatattctgcacaatccgtaagttttcgaggaggaataaaattgcatataaaaatagacgatttaactggacgtcaggtggtttcactggtgaatgagcatttacatagcatgacgcttatgtccccgccagaaagcattcatgccttaggtttagaaaaactaagagggcctgaaataacattttggagcgcatgggaaggtgatgaactagctggctgcggagcgctaaaagaactggacacccggcatggagaaatcaaatcaatgcgaacatctgcatcacatttaagaaaaggcgttgccaaacaagttctccagcacatcattgaagaagccgagaagcgaggctatgagcggttaagcttagaaacgggttcaatggcttcatttgagccggcaagaaaattgtatgaaagcttcgtttttcagtactgtgaaccgtttgcagactacagtgaagatccaaacagtgtgtttatgactaaggaaatgtgagacgattttataaggatagataagtgcaggggaaggtctgtcttatctatctttttttatattcacacatttttcacctttatgatacacgccaatgttttcaattttgtttaattcaaagaacagcgggaattacaaacgacatgaacgatatcatgcaaattcataaaggaggagattgatatgaaaagcatagttggtgtatatgaaactccgcaggaaaccatcgcagcgattgaaggcttactcacaaaaggctatgattctgatgacatttctgttgtgacaagccggcgagatacagattatttggagtcacgtacaggaacagaagtcaatcaagccatcgatgcacatcaggacgaatctgaatcttttttcgataaactgaaagattatttcacaatggatgatacttctacacacagcaaagcattatccgacttggatattaaaactgatgaaatagacaagtatcaagaagatttggatgacggaaaacttctggtagccgtcgatacagatgcaaatgtaaatgctcctattgataacggcaatgccctttcaggcggcttttcaagcacaaatgaattggattatacaacgaaagaagaaaaaacgatgccgctccgggaagaacagctgaaggtcgataaggaagacgttcaaaccggcgaagtagaaataggaaaagaagtgaaaacagaaaaaagagatatggacattccggtgagacatgatgaaatttatgtcgaacgccgtccagtggatgaaaataaaacggacgctgctcccgtcaacgattcggaagagatcagagttccaatcgttgaggaaaagctggaagtgactaaaaaaccggttgtcactgatgaagtggttgtcggcaaacgcactgttgaagaaaatgaacatatttctgaaactgtgaaaaaagaagaacctcgtctgaataaagaaggaaaagttgacggcttggatgatgatccgttaaataacaaatgaaaatcataagacgacaacaaaaacctcaaatccatttaggatttgaggtttttcttttggtacgtcccaggagagattcgaactcccgaccgacggcttagaaggccgttgctctatccagctgagctactgggacacgttttgtttttcgctttaactatcagcgacaagatttattatatatgggatgcaataataagtcaacggttttttagaatttttttcatgaggaagaaaattttcttcctcatgacattttcatagtgtgactcggttttgcagatcctcaatttcattgcctgcttggtcgtaaaaacggactgtcgcagcatcattttctaatgtcagtatagcatagctttctgtcctgcgcaccctcggaagccggatgctacctgggttaatcatcagttttccgcgcagcacttcgcttcccgcgatgtgcgaatgcccgaagcagataacatccgctccgagctcctctgcacgatagtatacgtttaacaaggtctgttttataccgtgaaggtggccgtgtgtgaccagtatttttcttgagccggcattcagaagaagctcgtccttaaaatcgccggcaaaatcgcaattgccttttacaaccgcataaggctccaatgcaggatgcctcgtttcaagctcagagtccccgcaatgaatcatgagatcaacttctgcctcatgccgtttcgcaatggtttggagttcttcttcaagcccatggctgtcactgataatcagcacgttcatgtacaagcttcctccttatgcctccaaaagcttagacagctttttaagcgcgtcagccctatggctgattttatttttttcatcacttgtcagttcagccattgtcttatctttatctttcacgataaagattgggtcatagccaaagccatattctcctctcggttcttcggcaatatacccttcaacatggccttcgactgtttttgtttcctctccgggaatactcacggccagtgcgcagcggaaacgggcggtgcgctgttctttttcgatacctttcagctcgctgagcactttttcgatatttgcctggtcgtctttctgttcccctgcatagcgggctgaataaaccccgggtctgccgccaagattatcgatggatagaccggagtcgtccgcaatcaccattttgttcactgctttggcaacagcttccgctttcagaatggcattttcttcaaatgtatggcctgtttcttcaatttcttctgtgaatccaatttcagctaaagatttgacatcatagcctcttggctcaagaatttctttgaattccttcacttttcccggattatgtgtcgcaataattgcttctttcatgatgatcaagcctttctgtctttatttcagttctggcagagaatcacccagcacttctttttgcttgtcaatcagctcttgaattcctttttccgcaagacccagaagaccgttcagatcctctcttgaaaaagtcgcctcttccccggttccctgcagttccacaaaacggccgctgcctgtcatgatgacattcatgtcaacttcagccgaggaatcttcttcataatttaaatctaacaaaattccctgttccttatcaattccaacagagattgcagcaagaaaatcagtgatcggatttgtcttgattgttcctgctttgatcagcttgccaatcgcaatcgccatagcaagaaatgcgcctgtaatggaagctgttctagttcctccatcagcttgaataacatcacagtcaatccaaatcgtccgttcaccgagcttttccagatctacaacagctcgaagcgcgcggccgatcaggcgttggatctccattgttctgccggaaattttccccttagaagattctctgattgttctttggtttgttgcccgcggcagcatgctgtactctgctgtaatccagcctttccctccgccccgcaaaaacggcggtacgcggtcctcaacagacgcgttgcagattacctttgtattccctgctgttattagaacagaaccttccggatggctgataaaatccaaatcgaatgtgattggacgcagctcatcgtgttgtcttccgtcatgtctcatgttttacctccgattgtatgtacataaaccatttttgtcccggaattgaataaagaaagaggcagccggaacgctaacctctttctttctagtatatcaaaaatcccaatttaaaaactacccgtattcacttgagatggtctggagaccggttctgtgagcttttcgcctttttcatttacaagctctgattttccgttcactttaacagagacgctttttacatccggctgctccgttaacgtcagcacaatgctgttcagcacttctgaagaaatcattttcgtcttctcatcggcgctgccgaatatagattgattgaaatccaacgtcacgcgcccgtctttgattttcggtttgctgaccagctttacatcttcactgaagtctgttaacagcccgctcaccttgcttggccctttagccaattcattgatggctgccgtgatgtcgtctttttccgaattgtcgattcgtttggtcaccggcacgtagtattcactgtcttcgttttccgccaagtagtagactgtcagcggatgggtagcagtgagatcatttacaccggctgtttccaaattaatgccgtctttgcggcttaaatcatctgagatcggcgtccctcctacaggcatctccttcagttcatgcccgtttattctcagcttcactttatctatcgaactaaattgcgtcagtgtccacgtcacagattgaacgattttctgttcgtcttctttcttataatttttgaactcattagagaaatcagctatcgcggttccatcttttttgatgtcaacgttaacggtggtgtcagccggcaatacagctctgaagccattcggaagaatttcagacacaggcccgccctgtacgaggtattcaagcgcctgcttagccgtgctctcacttttagggagaggcagcgtttgcgcaacaacatatccgtttttatcaatgagataaagctccctcataacagtagatgaggcttgatccgcttttgcggtatcgcttttttcactttctgtttttttggctgctgttgtatttgaattggcacccgcttcatcgttcacgaatgtaacgtcttgaggcggatcaatttcctcggctgccttatcagattgaaacaaaccgcatccggataaaagcaaggcagaggtgagacaagtggcaccaatgactgcaggtccttttttcagcatacttttccctcctaaggatgtttgtactattatgtatacgagcctctttaggaaatagaccgaagaattccggcaaaacagaaaaaaacccgcaacataccgttgcggggaaaactatcttttaatcggttcttgcagtgagatacattccacatgcccgacttcatggccaaaccaatcgtctgcgatttttgcaaactgatcacgcgcccctgttgtcaggaactgatgatccggggcaatcggagactggttcagcagccctttataagagagaattgtgctgacttcccgggctgtttcatcgccggacgaaataatgtttacgtgctctcccatatatctttgaatggcttcttttaaaatagggtaatgggtgcagcctaaaatcagcgaatcaattgatgtgtcttttaacggatacagcgaggttttaacaatctcgtctgctgttttgtcgagaaacttcccgctttccacaaaaggcacaagcagcgggcaggcaaggttttcaaccttcaaatcagggtttaatgccaaaagcgcttcttcgtatgcattgctcttaatcgtattctctgtgccgatgacaccgatatgctgattatccgtcacttttatcgctgctctcgcaccaggctggatgactccgaccaccggtataccgacgctgcgctggatgtcatccaatgcgatcgctgttgctgtattacaggcgatcacgagcattttgatgtggtggttttcgagtaaataattcgtcagctcccacgtatattgaagcacctcttcttcagggcgcggcccataaggacaccgtttcgtatccccgacgtagataatattttctttaggtagctgtctcatgatttccttcgcaacggttaaaccgccaaccccggaatcaatgactcctattggttgttccaacaaaatcgcctcattttctcttcatttcatgctgcagtttcatcaaagatttttcgaagatggctatttcttcatctgtaaacgattcgaacatatcacgcagatattcctgtctttttgtaatgacctcttggataatccgttctccttcaggcagcagatgtatcctgacaacacgtctgtccgccgggtccttgacccgctcaacaagctcatttttttgcatgcggtcgattaagtccgttgtcgtgctgcatgccagatacattttgcccgataattcaccgattgtcatatctcctaattcataaagccattgcaagccgacaaattgcggcggcgtaatcgcatattggttaaggatttctcgtcctttttgcttaatgatcgcggcaatgtggcggagtgacttttcaatatccgcaacatgctccaaaggttttgatgtcatttgtccatccctcactcaaggatctcttacgcacaaaagcgttccgtgtctattttccttcttttttgaagaaaatgcaagactcgcaggagagaaatagaggactttagtcaaacaacatcaagaaataaaatttaatttatgacttgcctacgttttgcacagcattccaaatatggtttcgaatgttccaaacaaacagcaataaccggctccttccaaaagaaggaataccggcaaggattaaagctctagctcacccattctaagaagctcaacaacggcttgcgaacgccctttcacacccaatttctgcatggcatttgatatgcatatctatcgcaaactaaaacaataataatcacttgaatttataatggaaatcgactgttccatcctcgtatattacaagtttatcaataagcgctgaaaatgcttcgaataaatcctgatcagttctttccagctgtgcgaatgcattcttaatatttgatatgtcgattgtttcttcttcctcacgctcaagcatgaacagcttatcgttcagtttttcaatttgttcttcaagctcttttcgcttcgcctggaattccgccttagtgatcaactgatcttccaagtacaattcgattagacgttttttcttgttttctgcgttttcaatttctattttcgttcgcttgatccggtttttcttctgctcttcaaaatcagattttacatccagttttaacttcttgcccttttgtttcagtgttttaataacaaaagcccgcaagtccttatattgcatcggagcatggtttacacaaagagcagttccacctcgtctgtaggcgctacacttcaaataattaaactctttcttctcacgtttctgattgtatttgtacgacggtagcacaaccatattgcaaccgcacacaccacatttcatcattcctcgtagctcattccgagggttaaaacgctttttacgcatcttgtgttctttgttattagctttctcatactcttcttctgatatgatcttaggacaccagtctttgtaaacagtccatttttcttttgggttgcggataaattttttccgtccccctattttgacttgagtatgtctattggcaataaacacgccacaataaataggattctttaaaatcgtttgtactgtagacagctgccaaaactcagtcttttgaggctttacaatgtttccgagtgccaattcttcgttgagcttgagaacgattcttttatgtccatacccatgattattatgaagatcgaaaataaaacgaacgacttttgcttcttcttcattgatagctaggaatttaccttctttcttaaatccaaaaggtacacggccggaatgttcaccacggcgagcttttgctgctagtgccccgctggctgccactgaaattgtttgaggatattgggcagcaaacattgaaaacatttcaaatttcattgagtttttgccttcatatagactatcgtacccctcttcgagcgtcacaactcttacaccgtgggccaataaaacctctcgaatttcaagggcatctttaagatcacgagcaagccggctgattgatttaaaaacaaccatcttcagctttcttttttgcgccttatctaaaatgagttgcatcgcttttcgatcaagcagcactgtcccgcttatcccatcatctaattggattgcttcatctttccattcgtaattatttttctcaatccaatgatgacaaatatcaatttggttggctattgatgtcacctgttcatctttttctgaggaaacccgtgcgtaaactgcataagggtaatcttcatatttgatgatctcctgtgtttctgtctctttgaagaacactaaaccaccccattattttgcatttggtacattttagtgtgattatagcataatgattacgaacctcctatacttttccggttgattttcgaacatttgttcttgtataatttgttcaaggagttgatcagaatgaacgagggtatttatgataaaagatgggaacaaaaatttattttgcctgagcaaaggacagcgctattaaataggaagaaacaagtccaaaaaattgaaaaacccatcttagatgaataccaattggaagatatggcccgtgttatttgcgaggcgatggaattcaactcggttctggtcatcggtgtatacagagacggttttatcgaagaagtaaaaggacatgtccattacatagatgaagtaaaacagaggctgcacgtgaaggatttaaaaggtgatacaaattttattgcatttggttcagttctttcagtagagcaaaaataaaaagaaccagccacataataagctggtccttatctttaattaaagaaatggttatgtaaagctttagaaaatccaaaaccttcttctggtccctttaaccagagagaaataaacttttcgaaatctacttctttttcaatatctttcaaaattcttttaaattcttcagtaaagttatgaagagagacctcttcgccatttttaagtttatcagtgtactggctcgttaactctcttaatccttgatactgtttttcacttaaatcataagccaaaacttgatcaaataagccaaaccgatcataatcagctgctaattgttggactaaccttagttgaaaagcctgtttctcgacttttttttctaggttgtcaagcctttcttctactgttaccaattcaaatcacctcaattaaaaagctaagaaagtaaatacacttgcaatagttctagctgtagaagattttacaccagcatcaattagatatgaggaaacagtgtcaataattgcgtcctccacaacgtcacctcgtttaactaactcgtccaaagcatctgctacatcatcagtatgttttgcgaaggtttttcctgctgatccacctaactcatcgactacctcaccaacaattctcccaccatgtcgaagcgcactggctgttgccttcattgcttctttagcaatccattttttaataccatttgtgtgaaattcaccagattgttcagttgtattagttgataattcggatagtttagcaggagtttgataagtgacttcttgctgtgcctgtaatgttacctcttgagctttggcatgtccatccaacggaagaactaatgataaagagaaagttaatgcggatgttgctaaaagtaatttcttaaacatgaaatcaatccctttcttttaaattatttacatgtaaatgatagcattatatttcgactagaaaaataatgctttttactcaaatattagaataattttgaactatctgtaacaaaataaacaaaagtatctcctcgagaaagatactcaaggagactatttatttacttcaagagcgcttctagtttcgctttcgtatctggtccatatataccgtcttgaggaagcccgtacattgactggaaccttctaacggcatcagctgttttcggtccataataactatctatcccgaagtttttagcttttttatccggatagaaatgcaatgccgccagcgctgtttgaatctgttcaacagcatcactgtgcatcaatgggctcttcactttgaaaatgccagaaggcagattgaaagatgatttctttttgcttgagcttggttttttcactgccttggacgaagttgttttcttgctggatgatttgccgccaagtgcttttaattcagcatcaatagccgctttaacctcattccagcgtccctcgtctaaaatacggtgagggcaatactttccgctccaatcttggtgcttccgcactcgatcaataccccatccgcgttctttaagcagctgagcaacaaacttgatagccaacttttcagcagccctgtatttaggccctcctgacttgctgtagcagatttcaacgccaatagacttacggttcccggtaccgtttgttccgtctcctgtatgccatgcattgcgatctgttgggatgccctgccttacctctttatcatcaacagcaaagtgaaagctcgttgaacttgtgtttccgatcatatagctgacctcgttagcagcagatgcatcattgtaagtgttatgaatggtgatgtattccgcggtcatcggattagggcattttaaagcgtattttgcttctgatacaaggttctttttcactgcgattgtcataaatgatctctcctattctgcttttgaattagaaagagccgccagctggcagctcacttggttagattgtgatttttcaggacagctttttgctgatggccttttgcagtcacatagttgtttttgaaccatgctgtaaatgtcgtgccaatagtaaaggctatagagcccgcagtgtacagcgcatccgcaagctgattcacctgatcctccgtaatatccaaaggtgatttgccaagcatcagcattgtttggttgataagtgcaatcaaaagaagcaccgtccgaatgaccgtgcctttgtcaaagtttttcatattgtgttttcctccttatttttgcaaaacagtataaaaaatagcgattgcgccgccaataacgccagtgcatatcgctgtaatgatagcgccagttattgtgcgtttgatccaagttgtattctcttcgatcttgttgagtttttcgtttaatgtcatgatttgctggtcttgtctatcagaaacgcgttcaagaacatttacacgctgttcaatcgttttctggcctgccttcatttccattatctctttttgtaatgcatgcacatctggtacctccgtcacttctgacattagtacgccccccttatatctatttcacgtttttcacctccttagaggcaaaataaaaaagccttattgactggctcctgtcgtttcctcgtatggttgacctgttacttcttggtattggtcatgtgtaatgtattgtgcctgaacaccttctttcaagtcatcaacggaacaatcgttaaatgccatagcctgctttaccatggctgttgtggcccatttgtagaacaacgcaaatacccagaaattaagattcacttgtcattcctccctttaaatagagaacatctaattttaaagatgcaacttgctcacctaaagattgattcaaattttctgcttcttttcttgctagcacttccgcagtcaattgtacgcctaaagcattttgagccagctcagcctgttttcttgccagtttttcgtctgccagctgttgcccaagtgtagccagctgttctgctataggattggtttcaggaatactgccttgtttcagctgctctttgtattcttcatcagcagtttcaacccatgtttgtttttcctcatcgaataaaggccgccacataccctctccatttatttctggaggaatatcagtagcattcgccgggataatatatcttcctgactctctatcggggtgtaactcaaccggccttcctaaatagatcttatcctcaccatatgggtatattaatttcatacttctccctcctttctttaagttagaggcacatctaagtcaatataatatccattcactttagactcagtattagccattacccctgttagtttcatatcaccagatgcatatataataatcttgctgtaaccagtggttccgctagttgcaaccagtttgactatccctttgcttggagcgctagaagacgggatactagcaaatacaatctctctatcagtaagaacatgaccattaagatgcaatgtatttccgactttacggtattgtaaaggtctatcacctgtagttgccccgtttttgtatggaacatttagccacggcgtctctataaagtctaggtctgtaataacctctcgccacccagtgaattctccctctttatgctttgttccaatccatgtacggttatcataggatcttgttgcgacaattttctttaacccttgaggtggagcaaggtcagccggaacatctgtaatatcataatagtaccaggcagcatcatcatcccccggatgattcagaacacctgccccaaaataaaagccagtcggataatcaaaaaggttttgtcctttagttatctttattctctgaccgttttgggttgtcaggggatagagttgtccattattccatttgttcttatcttctttcgttacatgaatgtctgttttattttcatgagtattgacctttgtttgggctcctgctgagtattcgatttccatccaaggcgtccagttatctgatccactcaccttatttcttatgaatttccgccgattatcaggtatagaggttgttgcactggtataagctgtgaattcctgatatggataagtgccgtagttgtaaaccaataaataaccattgctattcacaggggcattcagtgccgttgaagctgaagtcatataataaaaccctgtttcaataacagtattgaaatccacgcctgacaagtttttcatcaaaccattgtcttgtgttaattttgataactgagccgcattccacttggttcgctctgcatcagaaatatgacgaatctggttatagttatgtgcgtcaaactccgttttggttgcctgtttgtcattggtaacattaccgagcccgacttgatcttttgtcaccccatgagggttgcttttatcattaatgtgttgttcagtatacgtttttgcatttttttcggctgtatcagctttgttttgcgcccctgtagtcgtttccttcgcattccaatttgaacgctctgtggctgtgatatggcgtgtggaatctgtattgtgtgcgttgaattctgttttagttgcttgctgcacgttgtctacgtttcctaaacctacttgggcctttgtgacttggttggggttatccctacgcgcagcaaattcatctgtataagcttttgctgtttttaaagcagaggaaacgtcatcctgcgttgccccgatctcttgcaattcctttagtgcatgataggccgtatactgataccagttgaaccaatccgcagggggatgatccattggtttgtatccttcatcaatggaggactgcgggggccgctgcccggcgttcccccattcaggcaattcttttgtaaaaggcataaacatcactccttaaatcggtaaagggtaatcatcttcaggctgaaagattccgccaagtgttcccccatctgtcccgtctgttgaaaatccatattgacttgtttctatagagttagcagaggacgaaaaacgaaaggtgccgtttaaatctacataagccacccgtacgcctgcagcaactgttttttgaacgatattcgaaaactgtgttgcactcattccaactttgctcaaagcctcaatgggtgccttttttacgataatggcagccggttcatcttcattattttccttgctgctgaaaatgtgtatttcacttggcttgcagttcagtgttttggctaaagcttcaatgatccggtttgtggtgccatctgaaacatttctggcaaccttgccgcgaataagcacacgataaatttcatcagtggcacggcccctatcctgcgacacgttgtcaccaagtagatccagagcctttccttttgccgcatcaatatcccgccagttctcagctgtggttagcgcgcttttaagtgctgtcagctgttcatcgacaattaaaaaaagctttccgatattgctcttttcatctttcaaaaaggcatcggtcagctttcctattaagtctttaatcatatgtgattcaccacgatttcatcaaaatgtacctgggcaacctctttaggttcaatttcaatgtttgactgtgaaaggtttgtcgcatctttccccatcctgattgttacatcagagacaccatctacttgatataccgcgttgaacaactgcgacaatataacatcatcgcccatttgtgagccggtatagtaagagccgtttgcatcaattcccccgattttataaacgaggttgtttttgatctgacttactccatcaatagggaaggaagcatttgtttttaaatccagctgcagatatattttgacttcccttgcaaaatcaaatttgacggcatggtcaagtccgctggcgtcagttatggtgacaacttgctccccgaccgtttcaattcctgcagcaacactgtcaaacagtgcttgcgcaacatcatcttttgtaccgcccagaacataagcatgaatgctttttggtgggttgccgtccgcatcggtctgcatggtattgttggcaacaatattcgccgatctgacgcctgacacgcttagcagggctgaaataatacctccgtttgtagatgctgaactgccctcaactgatttctttattcgtgcccggaattccgaatctgtttcctcgtcggcaccgcctgccgatggttccggatttgtaactgaatacacgccctctgagggctctgcctgcacggtaatggtatttgccgcaacattgtttataacgcccttagaaagcgagacagccgtccctgagcctgtcccattagcctcaattacaacatcttcaatcaattcaaaatagatgcctgattccgtagtaaactgagtttgttcttcaattacgatgccgggttctccagtaaaggacagagtcacaactgactccgcagctggctcccgcgtgatacccgagttgctgccaagacgatcgagctgcacgccctcagacttactgacaaagccgctgttataaaccctttctgcaatgtcccacaagccggcaagaaaccaagcaaagatacgaataataattcctaatggtgttttactggatgtgtttacatcctccccgaattgctcccgcgcccggtcctccatactatcaacaagctcggaataggtttgccgttgaaagcctgtttcatcaagcaagatcaacaccccctatctcaattgtttcttcatcctcttttgtcattttcacatgcaccgcaagactgcgagactctttatccattaaaaagttcaccgattccacactggcaatacgctcttcttgagaaatggcatttataatgtcatattgcgcctcttcttgatcaaactgctttcttaaaatgttgctgcgatcaaggccgacatgttcatcaagctcaaactctcctaaacttgttctaaggatcatttctactgattgagccagctcagcatcaccctcaaccatttgtaactcaccattttcaaaacaaagatccccgtctttaagcttgagagttttcatccttcccacactcctatgacaactggatcgtttatactgtgtgtgcgcctcgaatccggatcaaaggttttattgccgtccaggttatccagtgaacgttcagcaaacgaaacaaacacgcaggaccctactttaatatcagcttcgacgtgtttcaaaacaggcgcatgctcgattaaagggtattcatgtagatactcaccatcattggtttgaaacagcaatttcagatcggcagtgtgtttctcagcattgtaatttacaacccgtgctggcgccgttgtatggattgattgttttatccgctgttcgaatccgtcaaagaactttgtcgctttactcattaaatcaccctacattctgtgaaaaagtctttaccgtcaaaggaatgagagccatctttcacacgatattttcctttcgctgtcttgctgtttatttctatgattgaagcaactgcgatacgatgctgcaataggcacttcaccttataccctttgagatcatcttcctcaaattgttcaggcgtttccacaagtcctgttgcctcttcgagcttgaaacgttcgtcatccccttgactgagtggccgaataacaggacggccgcgccgataatacatgactgccccagcatcatgaatgacctcttcaagattgttttcaatcaatccggtgacacgatagccttttttataaactttatttttaggcagaatgatatttttcacttttataccgagcacacgcagaagcttatcgacaatttgccttgaggttgtgccagccttgaacgtgattttcatgtatctcttacggtatctgacctctgtccgagtgccataatttcggaccgttttatatgtccggccgttcttatctttttttacagtcaccactggttttgcgagcttgtaccgctttttcacatagtatttttcagcaggatcagcgttttcagtggttactttcatatgggtgtaatcatcgccatcttttgaatagatggccgttaccttattcaaaccgtcccaattattcagcaccttggtaactttaccgatagttaaaacaccgtaatcgtctttataaccagcttgaacagtgatagtgctgccttttttaattttgctgattgaatctttgctcaggttgtatatttcaacctttgtttcattcggtttaaagtcatcatcaaacgggacctcaaaatgaatctctaagtctttataatcgaaagtggtttgtgaactgccgttatctatcgtgaccttaacgacgcgcccaaacagcattttattcgtcgccatcgtcttctccctccgcatcgtccgagacatcatcaatataaagaaacacggtttgcataaaattctcgtatgtaacccgtgtttctgtattcgattcatccatagggataagggaaggcgcaggcagtttctcgtttacaatgtcttcccacaaagggacgttcaaaatcaatttttcgcccagcacgattgattccatgtcttgatcatataaatcaagtgaaaaactatcgtctgtttggttgtaattgatacgcaaaatgaacgtgtcatctgctaaatcaaattcaaactgctgtggtatgtcctctttgtcaaaaggaatgtaatctcttgatgccatgcctttccctccttcatctaatcctcattttgacccctatcggaattcttcggtccggccagggattcaaccgacgcaaagcatttactgtggtgccgtatttacgagcgcagccccaataagtgtcacccttcttgaccttgtggtataacttgccggatttttttgttttcttcttgctggctttcttctttttcccggctgttttcactttctttttgacccacgggctttttgcaatacggatttcttgcaactcaattgaaatagcaaaaccgtttgtgtaatcgcctgtgtcgcgatctatctttgtgatgatcacatttttagcaaccttacgcccggtataagtcaaaagagtgccggcataagcctgctttttcagatattcataatcactatttgctgttttgcctaataaatagccagagactgttgtcgtctctggctttctttgtacatggtccgtgatcggaacccctttttcaacgggatatgaagtgacctccacatccgcgccatcagattccttttcgtttacgagattaatctttccgagcttcgccaattaataagccccctctggtggataaagcgacttcagcatgtcgaaaacttcgtcaaatgtttcagttacagcctttttcacctttgtttctgccccttcactgccgccctcaacttttacgttgatcgacgggttaaaagtgatattgacagatgaactgtttgagcttgtagcagccttttctggtgtgtaaccagtatccgcgccaagctcccgaccgagtgcagcatacattccgagtgattggtttctgtatcgtggctcagttgtgatgacatactccctaaagccgttttcaccaagcgcagcgacttgtgggctgttaatgactccacctgtcgcataacctctatacggcccaccatgagccatagaaacgagcccagggtgttttaaaataccgccgtatctgctgttcaaatagttgatagcagcaaggatctggtcaactggatttttgatatttccgtgacccggttccttgtgagcgttgaatgtacttggtataaactgcataagcccttgtgatggatggccagctttcgcattcgaatcccaattgttcacgacattaggattcccgcctgattccttcatggcaatagtttcaagtgcgccagcatattcagagccaagccccttgattgatagcgcttgagctacccactttttgacggcttttgaaccgccacctgaaaagctttcagcgtaactggacattttgcctttaacaaaaccaacggccttatctttgacaaagttaaaagccccttttgcgatatcaccgaacgagccagccatagaaggtgcagagacacccattttttctaagacttttgttaaaagcttagatgggtgtccgatgtaatcaaaaacatcaagagcaacatctttcactttacctgcaacggattttacaccattccatgcttttgtgaagatatttccttctgtacctttcgcgtaagctggaactcctgataaagcagcccttgtctgtttagcagataacacctgagtgccttttgggaggttcattagtgtatcacttgcagggctgagtcccacatgacctgatggagtacgatacatttcaggaccagcgtttgcccctttaccgtctcccagtatagccgggcctcccgggtgtccgccggttccgtgtgcatacttaggtacaggccattcaggtatatgtttatctttcaaaccgatcttatcaagtacccagttcactccgccgattacaccatttactccttttccgagtgctccggcaagtttgttcgctaagctagtcacaccagacacagctttatgagccatgttcttaattccatcaccgattttacccggaagtttcttggccccttcgactaaatcattgaaacgatccataactttttgacgtaaatcaagcgccaataacgcgactttattttttatataaagccatctatcagtgattgctgaacccatattacttacaagctttttcaccatgccgacagcactagaaaaaatttgcttcactccgtcccacatcatgcggaaattcccagtgaataagcctttgaaaaccttcactattcccataataatgccgattgcaccctgtattatcgcaatgatatttttaagtgcaacttgaattattgagagcacaaccgggaacacagcagtcacgatatttaggatgaaacggatcgccggaatgaccacagttgtaatgatattcgccagaaattgcaaaagagaaacaacaatcggaagtaccgcttgtatgatttgcatgatctgcgggaatacctgctgcacaacttgaatcaaaataggaagtgctgcttgcgccaactgtaaaatgattgttgccgctacagtaagcaattgagccacgattggaagaacagccatgatgacttgtttaataatcgggaacacttgctgcaccgctgataaaattaacggcagcacttgaaccgctatttgtccgatggatgaacctaaaagctgaatcaattgcaaaacaatcggaagagcttgttgtacaatgctcaggatcaacgggaacgcaagctgaatcatttgaaccaaaatcggtaaggcattttgcacaattgaaacaaggattcctgagaaactgcctatcaattgaataatgattggcagcactgcattaattacgctcagaatgactggaaaaatcgtctggaagccttgaacaagtaacggtaggatgctgcttgctatttgcaagacactcgtccataaagtacccgacaactgcatccaagctgaaagcaattgctgaatcagtggcatgatttgcggaccgattgtctggaacgtttgcgagatagctgcagcaaacaaaacaagcgtgccgcctatttgaacgaaagcctgctgaagttgtccggccagctgctgaaactgtggcgtcaattgcgtaaccaattgcccgaaagactgttgaagcgtgttgatgattggctgcaatgcctgaaaaacagtcgttagaacagattgtaccgatgtccatgccgtctttaaggcctggcttacattttggtttgtttgttgcatgcgatacaaggcgccagcaacactcaaaatagcaccgacagccacaccgattggccctgacactccgaggaatgcaagtccgatcgccgcgacaaacggagcaacaagagaaaccatacctttaaagctggatagaccgactttcaactgctccatgaatcctttcacgatgccgtttagaccgtctgatagtcctttaccgaagaagtccgagactgtctttccggcattatgaatgaagcctgacacggttttcacagccgttttataggccgactcaattccagccactaactgtggatgcgattcaccgagacgatcccataatttcaaggattcagcctgcattttatgaatggctgtgatcgccacgttttgtgcgtccttgaatcctttcatgaatgcaggttttaaaccctcagcttctttgatcatggtatggaatgcaccgacaaccgccgatttccccatgtcagcaaagcgtttcatcgcgtctgtagctggcttgaatctttcctgaagcttatcgaaattcttgtacagcaaataaatgccggttacaaggagaacgattgcccccgcaacgacatacaccgtgcccgacatagcagccagcccggttacaactggaccaatgaacatccacaaactgctgagagctccaaggaacccattaactaaccctacccctatcgctagtggcgataaaagtagggttaaaacagggatgagaagcataaatccttggatcattttcgagagtacagggtgcgcctcattaaactgaataatcagcttcgcaacggccgtaatgcccttgtatatcgccatcgcaaacgccgcaaacacttcgattgctggctgaatggctttcagtagtgtgctgcacatctcttcccatgcctttgaatagccgggaactgtttgtgttgctgctttatgaagcccttggaacatgaaaaagtttgtaaaagccgcgcccagtgccaccatttgaaaacgcatataaccctgagtgatcatcattgtcatatcgttaagctctttcatgttggcagtaggtccgagcattttcagagccaaatgcgcagcagttccctgctttgccatgttctcaagcgtattcgatacggcaagcccagctttattgacttgatataatgggtttcccattcggtcatagttcgccgcaatcttctcagattgagtggaccgagccatcaatgtccctacagtctgcagcatgctcatgcgcatcattttgttgtttttcatcatgttgtctgttacttgcttgtgagcacgtcccagcctgtacacttcatccataaactgctgattggtgccagaccagctgtccatctggttccctaactgaaagaaaccatactgggctcggatcaattcattccgaaaaccgttcatgccatatcgttcttcatgccaggcttgacgcatttcattgagcattcgtattgtatcggcttctagtccacgggttgagccgcgcaaaaagtccatttcacggttatactgccggattccccggtagtccggggccgggacagccaccgcagccacgttattctgaacgctttgcgtgttctgctgggtaacgtttgctgcgggcgtaccgatacggctcatatcgacgttattcaaattttgcctgagttgatcaattgattcattggcgtttgttatagacgtttgatcaacattgatattaacctcagacggaaggctttgaataagtctgcttgtctcttgtacctgggtattcagctggctcaaacgggatgtaactaagtcgatttgaggccctagccgttctatcgtttgactggcagtttgcaacgatgagttgtccaagatcatactcatatggatgtctctaaaattccgctgttgcctttgaacctgagccatccgtgtacgcatctgtgaaaaactgccgccagcatcgccgacatgatcaacgagtctatctatttgctgatttgctctttctagaggggaggtatcaacgttcaattcaacgtcaatatgcgtacttcttaatgcttctgacaacgttcataccccctcatttcttgttattcctcttgttttcttgctcaatatggatgtcgagggctgcatttgcctccattagggtatcgagatccatcatcgcgacctctgagaaggagaacttcccagacatcacgagtctatacataggccagttgtcactcgccttctttttgtaatacggctttggtttgggtttcgtcgataagaaaggattgaacctctttcattaattccatgaaaccttcgtgttcatcgaaatattcaaagctcactttcggttggacaacgacttctttcatgaataactcatacatagcagctgaatttggtttacctaaattgaggttgactgcttcgtcctgaatttccaccattcgctttgttcctgggtgttgaagagtgtactcaattcctttgatagttactttcttttgtttaccgaattttgacataggttttccctccgcttgtttagtttgcatatattgaaaagcagccctattggactgctttcgcgcgtttgatttcttcttttttgccatagcttaattactgttccaatactgtatagtcaaagacttgaatctcgaactcacgatctccaatctcgtcactgaattcagcatcggcaggctttttgaccatcgcttctgtgccgccgattttttcctgtccgcccgtaacccagatagggaaacgctgggccgtgtttgccattttattcaggtatggtacaaatggcgatcccatggaaagagtcagtgtaattgttccgagtgggttgtttttcgttgcaacactgacatcacccttggcgctgactttagtcgagaacttttcttcgtcttttgcacaagaaaccattgtgccctcggaataaccggttacgattttcccgtcaatgttcgtgttgacttcgtttgcatcataaacgtacatgctttatatcctccttaaattgagatttcaccagtgatttcagcagaatgaaccgcgccagccagttcaaaagtaaatgataggccgtcgtatacacggttttttctgttttcatctgtgatttgatcacgggtttttgtgctgattgaatacactggctgcccgtctgcatcttctgcaacaatgccatttgcaaaggctgtttgcagaacgtttgtgacctgtacactcagcaatgaaaaaccagcattcgagaacgggattttgccgttgtttgagaatgctgattgtattgaggtttcaatattcaatttcacccaatctttgccgtgcagcacgtcgatatattccccggatgcagtaatgccctcggatgtctcgttgtggcccgctttggttacataagcaatagccccttctgtatgcagctttttcaactcgtctgccttaatatcttgaggcgtgatgccaacgatatttttaaatttccaagttactgatcccactgtatgtgaagcaaccgaaccaacaaggccagcgtccggatgctcgtcatttaacgggtgatagaaaacaattgtgcgatccttgcctttgtaagaagcaacttcttcccggtcagttacctgtaaaactacaaatttatatgatttctcttccatcgcttttgccgcttccattctttcgtccgctgtagcatcagcaaggatcaagaagtgccagtccttgtcgaaatactcgtcaaacgcattccgaatggagaatgttgcttgtgtagtcgctccttcttctggcgtttctgtgctgcctccatacgtaccgatggcaacctttgacggtgcattgtcaccctgagcaaagatagccgcagcctttttatatgctgctgtggtttccggatagtctgccttgatagcttctaatgagccatattctttatatgtgttgtgtccgtctaccttcgcaagaatcagaggtgttcccaatcctttaaggctggacggtttcactaagtcaattttgactgtaacgtcactaagtggcatatgaattaccctcctgtattttcaattcgtacagagtcgaaaacctctgcatttgcttctccatgagacacacgcgttctaaagcgtgtatcgaagccgtgacggcgttctgtgtcaatcgtgataaatgtatctcgattgccgaaaccgtcgttcctgacccatgccagcccattatcatgaagcttttgtcgcgcttcagctgttttgaagtacgctgctgtttgttgagcaagggaaatggcctcaatatggctgtttgaaatccatgtaaaagagaaaacaagctcgatgtcttccgttaacactccctgttcttcaatgcctctatgttggggcaaatacggggaagtcacggtatacgtacaaaaaggatagacaggttgtttccctgtaccatttgcaacgataacgacatggcctgttttctctctaatcagtcccaggactgtttgtattatgctgttgtagtccatctgaattgatcaccgcctttaagatatagctgttgaaatcggcatacgtcccataaggcgtcatcgcttcaacatcaaaggtggcgccatcaaaaatcacctgagcttttagaggaatttcgttcttgataaatagctgcctgtccatagatgtaagccggccgccagattgatagacaagttgtgactgtaaaggtactattgcccctctttcatctgacttcgtcggtttcggtggcacccattcgccgagatcatcatatgaaccctcttcagatggaataagcaatgtaaaatcaacgctgtaccgcttaatcagatcagaaaatatgaaatgattccccatcagctttcaacctcataatccatagagccaatcatttccccggtatcaaccaatggatttgaagagcctttctcttcggttgtaaatggatggtttgccgggttccgcaagtctcgggcatacacttgaagccgccctttcgcaagcaggccgactgtttccatgatgtcattcatcgaatcgccattctctaacgctctattgaccagatcctctaccttttgaacgatctcttcctcgttctcgtcccatccagcacggatgaaagaacgctccggaatgttgatatattgagtttctttcttgaggtacagcccttttgcagcaaggtagttccgcatgcgatcagttacagcaatacggcagccaaattcgtgaacagccgcgatcatttgccgttcactgtccaggattccaactttcaccttaccgacggaaccgaggtttcttatgacttctggaatacggttgctatctcgtacccggacgtttctacgtgccattagatcacctcagtgccctaaagcgtatttttctgtagggtcggaataactcatgaacaggattgagcctttcttcatcagctgcataggatctactcatgcctccaattgattcagatagaacaccggacgggctttctctgtcaatcttaattaatagggcaatccccttttttacggccggaggaagagacacagtattatctggaccaacaaagagattgttgcagtatgccatcgcatatgaaatactatcttccagatcaatttgcagtttggcatcctgcgatgtgtcttcagctggaatccctaacctgacttttaattctgccaagtccatttttctcattcctttcaaagaaccggttcatatgtcgcaaaacatcggcaattaatatcattggatggatcaccgctttgtcccggcgcttctgctgttacatgaataccatttttattgatgccaagatcaaacaactgattgaccatgcgttcctgcccttctaaatggacatgatccgcatgttttgtctcacggactctttcatcgccaacgttgtgccaggtctttttcatgttgatgccccgtgactgagcttttttagcagcgtcaagcgttgctttttcccttgtgcgatgcatttctgtattggctatgcgcttcgatcggttgtaactcaggccgacatctgtctgcagctccttcgctatctgagcaaagcgtttccgctcaataaaaccgcgttcgattgtcttgttaatctgctgtattgtctttttgcgatcagtttcaatggctttgtccatttgtttacttttaatagcctgctgaacgtctccgggagcccattcagcaggtaaattcatctgattcagtgttgcttttggctgcgcaagtttgatccctaacgcagccagaacgccaaatatcagccagctgtaagatgattcgtaggtttcttcaaggaattctataatcatagctttgactttcgctgaaagatcactaatcaacgaggtgatttcccgctttatacggtttagatcaccgtgtcgattagcgtcagcaagtgtcggttcttcgatttgatcaagcttgacgaataacgcagtcagctttgacagcacctcttttgaagcacgctgaaaaagccgcttgagtttccgtaagaattccttagttttacggttcaacggcttcaaaagctctttttcagtttgttctttatccaccgcttaccctcctactcctcggctgtttctttggcgtcagactcttgtgtgtcctcggcttcttttttatttgtgcccttgtccagcttatatccaagtcccttataaattacctcgaaagcacgttccgtcacttccaaagagtctctccccttcttgatcctaaccattaggcagtggcacctccatcaacagcagggactaaggctgcaaaggcatcctctgcaagagtagtgaatccgacttccatagttgctcgaagtgcgaacatgtcacgctcgaataagtttagaggttcgccggcttcatctacagttgttgtcaacgttgcatcctgagaaatggtatattcaatgtcctgaagaataccataacgcgcatagtcccaagcccctgtaataaggtcagcttttgttttatcccatgatttgctgtcaacaaacccaataggcaacccaagagcttgaggtgttgcatctgctgtcacttggttaaatagtggcagcccgttattatcttttgcagcgcgtaacttttgacggaaacgtctaatagttgtaaatgcatcaggatctttgtctgcatcttctacaagcgccattactgcagcgagatcgtcataaacagttgcccctgaacccgcgccagtaccagatgtgatcttttggccggacttgttgactctttccatgattgatacacctgtctcaaaaggcgatcccaccccaaacagtgcggcttggtcaaacttgattgcaaaagcttctctaatagctgattgcatttgagtaaagaagtcagcaactgtgtagcgtaagaattcttttgaaactggaatgataaccgcaagtttcttcgatgtcatttttgctgtgagccatttggcgctgcttgtttgaatgcgttcaccttcaccaacccagtaagcgccaggtccttctgctaagtacgtgaatgtctttaccggttttgtcatcggttcatatttagcaagctgtgtgattgcagatgtctgcataaattctttcaacacaatttctgcttgttcttctgggattttcccagttactgcatcttgtagtaatactgttttgggattaaatgttggcataatagccctccttattttctgatatttgcttggttagcgagtgccccaatatcaaccgccccgccagctggtgttggatcacctttttcgaagttagtgccgctctctttgaatttgatatctacagcattttgaactgctgcattgaatgtctcttcaaacttactgagattggcaagtgttgtttcctcgtcttcgccaataaaatagtcaataactcctttaggcagcttcttttcatccgctacattcaaggctttattgaccaatgcttcacgatttcttgctttttctgcatcttctatttgttttttgagcttctcaatttctaattcagccggagatttatccggattgcgttcacgaattttctcttcaacgatgctatccaaattgtttgccttccatgttgcaagaccttttgtgaagtaggaatccaggcgtggctgaatgaatcgttttccctcttcagtttcaaggaacccttccaccttatctgctgatacggccgaaagttctcccacaaatgcttttacttgttcattgtctttattatcttcgagaaattttttcacttcttctaaagttggcattacgtttcttcctccttcgccctctacagtacgcgcctgttatgagtgcatgaaaaataagcctttttaaagtcatgctcaggacaaatacagatgatcactttgcaacctctttgaagtcatcctcatgtcgattcttatgccagtttctcgttgtattgtattcatttttcgctaattcccattgccatatatctatttcagcaggcggattctctccatttgacaacgcaattgctttctccatagctttttcgaatgtagggtagattcctaccttatggggatagcagtcataataatcatcactcgtgtactcaacttcaaagaacgtcattacttacacctcgaatgtcatcattgtccttttcatcctcaaaatcataagcatcttgttcagctttcattctctcaatctcgtattgcacatcatcgacaatagagagtgttgaaaggcgtgtctcttcgcttacctgacctttaagttgtccggatgtctgagcctcttccaagagatttgacggcagattgcgcttgaatgagaaccatacctttaaataatcacctgctgatacaagaccttttttcgcccatgctgagcaaagcaatttgtactgataccgaagggcagcagtcgttttcctctccatcgtgatgcacttattttcaagggccatcagcttgtatttcattgcaacgcctgtcacattcccgccgaatgattcatcagagaaattgaccgactttgcaaaacgaagaatgttttcttcaagcctgttcagatggttttcgatcatggtgtcattaatgtcttttgtcaggaatttggcatcatcatctttcccaaacatttcaagcacaccggtctttttcagttcttggatgtcttcatcatccataccagcgccctttaaaatcaaataagctagccgtagctgttcaatctcgtttgatgcatctgaaagtgtgcgatcgtatgcatctataagtttaattaccttttccacgtcgcccatctgttcatcattgttaggcaacccgaataaaggacaataatcaaacaagtggagcttcttctctaataaagtccagccacctttttgtttttcgaaaaaataggccatcttgtcatcgtaaaaagtggctttttcacgctctatgctttgattattgacccaatcaaataccttataatatctaagtgcgaaagaaggctctgtgatgtcattctcagcaataatgacaacttcccatggatttacattcgcaactcttaccgagccgtcaggagcgatatacacaagtctagcaccatatccacaaatagctgctttcttaccccattcgctatcagcatcagcaatgttatttatggtgttaaagttattgatttgctctgccaaggccgtatttttgttttccccgtctttctccgtctcgtatgagattggatggccgaacatatacccaacctttgtatccactatctcagcatcaaaagcattattcaggcggttgtttaccagatggtcaatacgccgaacctttcctgtttcaaaatcatcgaattgagctgcctcccgctgtaagatcggcacaccggcaacactagccatatatcgttcatactgagctatggctttatctttgatcggcttatgctcttcaataatctgttcaatgattggaccgtctatctcattatttcgaagataatttaaaaacttgttcatgttctcacccctttcctttgcgtctcataggtttgttgtgtgtataaatggcatatcggatagagtcgagcacatcgtcccactctttaactggctcgcctgtatttggattccaaacatacataaagatctcttttttaaagcgactaactttatcttcaacaataaaaagcagatcccgtttgaacagccgcgccacttcttcgatacctgaaacaactgccttatcagcatctaacgcacgcaacttctctctgcgaaaacgtacgatgtgttcaggccgagctgtatcacaatagaaattaatgttgccgtaccgctctttgatgtctttcgctaccttcacccagtagtcaatctcttcgtgccgcttgcaatgttcttcaagcaaataaaaacacccttggtcatcttgtccgattacgacaatagaacccgggtgatcatatccccagtcaacaccagtaaagtatttagtgaagttgacttgtttatcttccatttctttagaactgatatagtgcttgtctttgttaaaatccttgtatattacgccttccggagcaacccagtagccgtaaatatccctgtccgtaaacatgccgctcggtgttgaagcaacaatactttcgacatactcaggatcaagaaagttgttatcaaacaatgagaagtgaaaagaacggatattcagcctgccgtttttcagccgctgcccgtctttgtcgatataatccgttttgacggtgtgcattgggttttcagggtttgtatccatcatgaccattgcacccttataggagcaacgagaaatgacttccttcacgaatgaatcatgcagggcagtcgcttcgtttaggaatgcgccagctgatgtgaaaccccgtgcctttttccatgagtctgcatttgcaccatcaaagcaataaacacggtttccgaatatctcaacggcattcgctttatcaaggcgcaattcttttccaaggatcagttctaaatcatttaggatattccgctttatagaagcctgagttgccccgccaatgataaaagaaagccccatgttttgatatttgctgatgtgcccgaggaacgtcaaaaggagcacgaatgttttccctgcccttttcgccccgctgcatattaagattttcggctgctcttcaataaagctgttccatacttcttgttgcttagagttaagttccatgaggtttcaccatcttccgaagcatggcagcaacttcattttcttgagagtttccgttatcaccatcaatatctttcttcgccttctcgatattcaagcgcatttgctccaatttaaggcgacgttcgtcttcttcatgcgccagtagaacaaactgttttatcaagcttctgagctctcccattgcccgagattgagcattcaggaatgtggcctgacgatcccaagcgaactgtatttcaagttcttcctcaacaatagacttttcaaaatactcgtttccatcttcgtcctcttgaggttgataaacgtattttgcttttttctgttcttttacaagatcatctttatcttgtacgaacatgataggctgcgcccgaataatggctgcatattgaatctgtatctgatcccatataatatcagcaggcgaccgttcctgaatctcttccatgatttcaagcgtttcttctggcaggaatttagagaaaaagccgtgagtcatagcgttttgattcctctgtggtgcgccgccgttattccctaatgcattcttattgccgggtggtgcgcctgccttttttgtgtgcacacttttttcagtgggtgcacccttttttctttcccaaccatgccgctgtttccacgattttatggtgttcactgacaccccgtatttctcggcaaggtccttgtatttcatacctttgacgtaatctttctgcgcctgaatgtgcttctcagccatctacattcaccgccgcccccttttgaattgagttgttttggaaaaaatattccctctaaaccaccaccgtgctcaagccgttaaccgccaattgtctatcctgagacttaccggaagcagtttacagagaacataaaaaagagccatatagtttaatggctcttcctttattcaacaatttcaatatgtgtaatttgagttgggttaataagaatagattcaccaagatcaatcagacgatttttcaaaactctttcaccatccaattcatcatgaaaatagtctataagattttccacatctttcatatcttcataagaaatttcaaaagattttttattactcattagtataaacactttcataattttcacctcccacctaattatcggataaggagtgtgacaagggaactatttgcaaaatttgtcgaacgaaagcgcccttcataaataggtggcagtcgtaagacaaaaaaagcatccccaagggatgccttatttaatcaaatctcttaattctttaattgtatggaaccattcgcaaaatttgtcgaacaaagacaaaagaatatcactttttgtttcttttttttcggttgttttttgtctgtgtttctatttgcacactttcagtttttttgtttttcttctcttcagtttctaattcttcaattgcttcttctaatagcattttataagtacgtagttttccataataattaagattttttgtcacaatccatatccagagaccgattaaaattaataataaaatcccgttaaatattactatataccttccgaaggttaaacccgttttcacaatagtatctaaaagttctgtcggatctatagaatgttttttatcaatatttactgctatgttggagaaagcattaaaagtgttaaaataaaacgtaaaaatacctattagaacactgatgagactcgtaaatagtgatgtatatatagcaaatgggatagttttaaaagaggaaatgtctcctgaaactttaaggctgttattcaatctggaaattaatttttttatttgttttggttctagtttctttttgactttctttttaaaatcttctccacttttaatattggaatcctttttataaggtgtaccgaaatgctctaagtatttagatacatgagttacttcgtcaaacggaatttctctaatttcacgattatctttttttcgataattaaacacttttctccataattcaaccgctaattttttcactatatcacctcctatattttatcggacagacgacaaaacttcgaattgcttgcaaaatttgtcgaacgaaagctctattcaaaaagtcagtcttaagacaaaaaaagcacccttcagctgcgggtgctcatttcttcctatgcttctggaattccaatatatcctctttaataaaaagcctgtccctcggcatttctttaaccggttcaagttgaccggttttaattagctgattgagatattgacgagtaaagcccaatatttcaatcgcttcacttgtattaacgatctcctcattcaagaactttttaattgcatcacgctctttaaggctgtacaccaagcatcatcctcttttttctcgatatttttgataaagggaaattgacttttccacaattgaaacagcaaacaaaacaattatgcatatatctaaagttgtctttaatggactggctgcgacatgctgtcgaacaaataacatgtatcccaaagcaagaaggacaaaaatatcagttgacattcttagtttttccatttgtttgaaagtggctgctttcatcgttatataattatttgtgtcacttatgttatacttggagcaagggagaagctccaccttctccctcggctcaaaatcatctacgctttcttggtcgtctgcgtcttttgattttgggcttttttgttttaagcttttctcttatgataagagctttttcaaagatagtgagtgctgtaagtatgatgcccagtatcactgcaattttagccactttcgttcccccctttctatactttaattatatacgattactttactcacgtcaagttaatttagagaattttttcctgttttctcataaaaaacacctattcatgctaaacagaataggctgtgttctgctctatttttcattttcaaacgggaacgctcaatgtttttctggactgttccttttttaatgttcagcagctgggcgatctcctcgaaagacatgttttgcacagtatgcatgatgaaaatgtccttctctctttcagtaaggacagaaagggcatcagcaattctttctttgtcccagtcgcttacctctccttctggctcctgattgatcgcatactcttctggcattgcatcaatgatacgaggatcagcaagaatcgttctttgataaacgtctcttctgtcagctccccggcgtgctcccggttgtctcccgttctgcagccattcgagagtgaattcaatatcgctaatcatactgccaatgattttcttatcattcttttgttccgctgtcatttcattttctggtgtttctgagaatgcccggtacatctttctcgcttcttttaacgctcttttgtattcaatgattaaatcctgcatgtttgtcctcctcttatttacgcttaaaagcgccgcctttgcatcttctgagtgtttgcctgtctcgcctgccaaaacctttcagaacgctccttcgcgtttttactggactttttcttctcttgtttcatttcgtccctccgttcaaataaaaaaacggacaccaaccaaagtacagaattctctgtacagtgatcagtgtccgcaggctttccatcttggactttatttaaattaaatgttttttcgctatagtaaataatggcatagctatatcaaataaattcttctcaccaacttttttatagactactatatttccatccttcgttaacaagacacttagaatatcatcttcgttttctattggattcggcacatctaaacgcaaagcagaaataattccatcactttcttcataagaactccaattttgactcgcggtaacagtacccccacctaaataggcaacttctacatcggctatttttaaatctctccaccaaccaccttttattgcagcattatcattttcttctaattcttcttttagttttcttaaatctatagttatagcttgtgagttatatcggttatccccacgtcccacagtcccatcgattaatcgcttaatcccgtgttcaataattgattttttggaaccccaaaaatataaaaaatcatcatctgatttagccacattgaaagtttcatcagcagaaatagcaattatatcgtgtgccgttccatcttccaaatagccttttcctgtaaatgaatctcctattggatgtattacttgatacttttttaaatcttcttctgtatattcagtactacctaggtttttaagcgtagttttaaaagattgactttcagaaccagtattaaattcatttgtttctaatggtaattgttctgggaaattgattaatctctgcataataattgattgcggcatttaattctctcctcacaaaatcaatttaattactttgtccaaagctttaattaaagatgttctttgatttgtcaccaaaactatattcttttcatgcgcacttaactgtacaccaggattacttttaattttaatattaaaagataatatatcagatggcttaacctctttaataaagtgttttttcatgaagtcaacttttttagtgtttttagcaactttcattgtatacttattctcttccacccctaaatcatcacaaatcctctggtaaaagtgaactataaaatcttcaataatttcttgtccatttttatactttaaagtagcagatgcacttacattcaaattcatctgaccaaaattatctgtttggataatcgagaaataaatcttgtatggtttaatgtacattttaacgttgttaaacttatcaaaagagacttcgactaactcatttttgcgccctgtatgacctttattttttagtaaatcataaaaaattgtttggacttccgtataatcatctttaattttttgtagagttgaattttcgactatgttaaaaaccgcttgaaaatctatatcaaaattatcgaaattaaagtgatttttcacccatctaaaacccactctaaatttttgggatttgtcatatatagttttaagtaaagctgctaatgttggtaaaataatgattcctgttgcccaattaaatccttttgtgtaaaactgaaaaagcattgttgcaagaagactgagtagcattaaaacccacatcatctagcccccttatctaataatgtcattaattatagccataagatattgcttggtaaacattctttagaattaaatcaatcaacttcctctgtctaatttacaacaatgtttatcttttccacagttttcagtacaataataccatttattttcatattttttctaatttttttcaccctttttcacccctccatcgttttttcttttttgatgaattattttcaaatctctatttcctcctcaactcaacgcccatgctgcagccgcatttcgggcagcgtgcatctgggcggatttttatatctaattcgttgtgaccacattcaggacagctgtattcgatcatggtgtcaccccctattcccagccgactgcaattgcaaagaataaaaccaaaaccatcgccccgattagccagccatttgtcttatcacgctttgcaatgattgtttcatcaccgatcattttcaaatcgtctgactttgccacgagaactggtatgtaatctggatgcactttcaaatattccgccgcctgctcaactgtcatcgcttcgtctttcgtggctttgactgcccgctgaagctcaacttgtaaaggaatcatttcgcatcaccttctttcccaagcgaatcccaatcaaacgtttcaagaatcttaagcaaccgttcaacttttggtgctctccaagctgtcatagcgtacgtatgagcttctgaagtgtaatggtgcttgttcaatttgatgtggctctttgcttctgcttttgtcaaaaacattgtatttggttgtataatgtgaacctttctttctggaattaattctgcttcttcatcaatgtatttttgaatccactcaacagcatcttcatagtcgtcctcaatttcttgcaactctgttaaggcttccttagacagctcactatcttcttttatttcttctagataatcatcaaaaacataggcttctgcaatatatggcaggtatacagaataacgctctgcgttttcctcccgagcttcaacccattcataatcaccgactgtccaaaaccgtggtgcagcttgagaatcacgatcctgtgttttcaattcattttgaagctctttcaaaaattgaatatccttgttcatttcacatcaccctccaattcattttgggcaactgttatcgcgaaattgagattggtaatgatcttctctaatgcctgtttgtatcgtttcctatccccgcttaaatgctgaatgtccttttgagcctgccggaattgatgaaccgttacttcctgctggcgtttgttttcctcgatgatttcccgctgtttttctactgattgaattagaaattcttgatcctcaagaatagtggaccaattaacatcaattttctttttataaagtgaagttgctattgaaaatctattttttatttcctgtaatttatccatgccgttcctcccccgcaggggaaagcccctgctatttgattttgaaacctatttcgtgatcgactcgagcaaagcttccctttgccgtttgaatgattgttttgccatgctccggggcttccaagacatgtgcggtgccctggctcccgtctaaaacgatgatctgtattttgcccgactccattgcctgttcgattgttgtatctttgcttaaattaatttctcttgggttgtacattcttagcgccccctgtgctatgatagaagtaccagttcatatcagagcatcggggcatacgcttcggtgctttttttgtgtttaatagtgatccggtttccatccagtcattgtgaatgttggcgatggtttcagatcctcacggtaaacgatcgggtgttttttcacgtattcggccagctgttccggcgtcatcttccattcttcaaccggtcctggcaggtaaggattgatgctttgctgttccatggtatctacctcctgaattgattttgggaatttccgtgccgccgagcttcttgcaatcagaacccattcggctggcgcatgccttaaactgagagcaacgtgtcatacaggccatgagcttatcttcttcctgcacccacaacggccgatcgtctgcgattaccacgtttagcagtggactttcccgcctttcttttgagttttttcagctcgtccagctcgatgaagccgagtgacttatccagagccagcaccttgagtggcgtatcgtaaagccgctcatacagcttgcgcttgatggcaaattcctttgtttcaacgcccttgatgtcaatgatctcgatgctgccgtccaagttatgaacctcaaagtctgcaatatattcaatcttccgaaaagttttgccgttctttttgaatgcctcttgcagcaggaaccgtggctgcagcttaaaatctttgatctgcttgctcaccttgagccatttcagctgctcatagtatttggcttcggcccggctgtcgaacgtgatgccgtctacctgtgtttttcttgcgccgtacttatttgctggcatgtgatgcctcctgaaacttattcttttgttctgcaatctccatttctgacatgccgcagtcaatacaacattcatagtcaggtatttgcaaatgaccttctcccggcatagtgcagtaactcatttccatgtgtttatgttcacaggattcctgacgttttttctgttcagcctctttgacaaccgagcagtattctctttcgtgcaacctagcaccgtgctttgtcatcagccgctttccgcaatgttcacactggtaaagcgtctgattttctaacactttcattctccttacctcccgtcactctcttcccattgctgaatctgcttttcttttgctggcgccgttagtatgattgccggcagcagcatcaccgctttaagcactcggcatcagctccatttgtctgatcttttcctcaagcacctggatagctggtgtgaggtccttgccgcccttttgttcagcaggcccgaacaaatacattcctttggatcctataacgttcgttttctcgttcaatcccaatcacccaatctatgatttaattccatccggttgccctgaatgatcaccgtgtaatacttgcacatctggtaaatccgagagcccagcgcctcgtcaacgtccagcagatcgtccgttgtgagctcagaagagatcagcagaggtttatggttcaggtagcgataattcacaactgactggatctgttcgacttgccattcagttgcccttggcttcccgtcaactggcttgaataagtcatcaatgaacagcacatctgcttttctcatggcgttcagctttgtttccagctggtcaaagtcatttttcagatcactcatgccctcaacgtaagggaagtacaggcagtgagttgatttcttcttaatgagattgttcatgatggccgttaacagatgggttttgccgctgcccggctgtcccagcagagcaatgctattggcacgctctcccttgatcttttcaaagtctttgaagtattcgaccgcacattcataggcatctttaatcatttgaggtttgccatctaatttgaagttgccaaacaacagcttttcgaacttttctgtaatgccgctggctgccatgagcttcgctattttcttttgtttcacacactcacattgtttggaatacgtcgttttccattcccgagccttatccggcgtgcaaacctttcctgcaaggtaatcatcttcaagaaccatttcatcaagtgataggctgtccaatggcttgtgttcttttctcaaccgcagctcagtgtctttgtggatgcggtagatcacaacgccgcgatccttgcactcagagcattcatattcaaccttttcttctgattcggcctgttctgtttcccaggaacgcgatcttgcttgaagacccttcatcattgcttggaacgctgtgtctatactgactgctttgtttattgccatactgttgtttctcctttctcttttggcttaatgggttggacaggatcgcctcaatgtagttcaagccaacgttgctgcctttatttctgaaagcctttttcattgcctcgatgaccttctcttcgccgtaatcatccaccatgtagccgattctttgcgcctcaatggagccgatagaacgagcgaccttattttcgaatagctcaaaagcgtttttcatttttggatcaacctcctgcgtttcttgtggtgctggtgcaagttcaggaacaggcttttcagatggttcctgctccgttacaggcgtttcaaatgagatcagcctgtattgccctgccttcctcccctgcggcttatattcaattcttttaagatcaatcagcatctttcggtgtttgatcaacgtattttcggaaatctcaatctttgcttgcagagtggtatttgaagtggtgaaccactctcgccaccctgccttattgttgatgtgcaaaagatgaaaccataatgcttgagttgtagcagacaacggattcgtttctagccaattcatgaagccgttcatttctttcaggtagttcatggctcacctacttcctttcacacagtgctgtcattccgctgatacggactaaacgtaagccaggttcatttgttctgagatagccttcaacataagcacggaacagctgcgcgcgatttggcgccccttccgtcagccatttgtaacagaaggggatgccgactttaatcaaatgggaggtcatcttcgctgatgtctacaggcttgccgtcaaaaggatcagcgtcctgcgcgcttggtttttcctcagatggttcggcatcaatgatttctggctcagacatttcgtcagtgatgtcaatgcgctctcgttcctcgttatcctcaataactgccttttgcatttcaacagagagtatcccccacttgctgagcatggattttagaacggttttgagtgccatcgcatcccagtccttgccccaaccgaagtccgacttgctaaatttctttttgtgtttctcaacttgcgcctttgtccaatagacagtttttcggaatccatttaaaagctcaaaataagcagcgtaaccaataaccgaatctgattcccgcttttcaaaatcaatatcaatttcctcggtcaacggattccacttttgcaattctccttcatgaaccggtatgcaattgatagatttatattggcccgtccgcaaagcaagctgaatgtatcctttgtaaccaagctgaaattgcgcacggcctttatacggaacgatccaggcataacctaagttcttatccactggcaaatcgagcgttgccgccaccatagccgatgaaattacactcatagggtctgccttttgaagcgtattttcactgttgtacaggctcagaattgacgctgtgaattgagacgctctttttcccagaacttcttcgaatcgattcatgactgctggagaagaaagcaggcccttcatcgttgttccctgctgttgtcctggggcactgttttgtttcttctgaatgctgtttttaagcgtttgatttgtagccatattcagctaacctccttaattccaaagcgcctgaattgcacttcttttgtgactttctcgtatacatctggaaactgctctttcaatttcttgctatcgatccgattagttgaaactgacttccagctagtttgatagtttccgatgaatccatattctgcttccttcatttcatgtttgatctggttttctaattcctttgcctgcaatgacagctcgttgatctgctctttcagctgtaaatactgctgaatacgtgttttattatcagatgtgagatcaacgactttgccgccttctgcttcggcataacgttgcttgagatattcttctgcagcactcgaaccgtcaagaaccggagcctttccgcccaagaccttttcattccaaaattcaatttcggcctgaaagatcattgcaataagctcgtcatcgcgctcaatctctttccaaacgaatttattgccgccgatcagtacagcaaaatatgcttttttatattcaggccccagcactcctagatagtgttggacctgaacaatatagctgtcaggaatctcgtcatcttcccactctttcaggttgtatgccgatgtggttttgcactccaaaatggctttttcgccaacaatcattcgatcaacgtttgccaatataaaaccgtgcttaggatgcctgagcattgcttttctccgccttacttttttgccgctacgtatctcaaactcttttgcaacgatatcttcaaggagtgaaccgaagtaggctgcctcacttcctgattcactcacaggtacttgacctgttttgtctaaccataattcaaacggtgttcgccatttgtttatgcctaaaattacagaagcatctgaaccgccgatgcctttccgtcgctcaagaagccattcgtcccgactcatgtccgctgtcgaagcgaaaacctctgcttgcatcagagcagccccacctttcttttgtaagcttccgcaccaagccgctgccattcccggtagtgatccattgaaggaaaactaaactgcgctttaccgtttttggcgaatacaattgaaccgccgacctgtctcaaacgttgctgatcctccgcacgctcgctgaacgccactttaactgctttagccatgtataaaacctccattgattttcttgaggctatctggtagaatattgatatatgagttttcagatagcctttaattaagtccactctgccaagtgggcttttttattgctcatttttaaattcaaaaccaagatgctcctttaagtaccgctcaaggttttccctcaagatgacttcaccctcagcgctatctatcacgtaatcgtcgaaaggcgttacttcatccccgaaaaaatcctttggtgtttctggctcagtcagcttgtcgtgccaattgtttagaatcatcgggttttcgatcgtcattcatattctcctttctgtaattagctatgcgttcatcccaaatcagataaagttcgctatgatttcggattctttcacaccatgctctgacctccaacgctgtcgctggtttatgaacaaagtgaaccatcatcctaagctcctgcgtaccactgataaatcaattccacgctgtttcagcctcatcgctgcatcatataagcatcccttatttgaaatccgtttaagatcctcaatgtttgctttgatactgccaaggatgtctaaagcttcctcgtagtcgccttctttcaaagagtccagtaatagttcagccaaactttcaactgaatctgatttccgttttacgacttcttcatctgacttcaaaaaatggttgagtttcatacgagcatcgccttcctttcctcttgttttgacatagcaacttgatccattaacgctttccgcgtccatttgtctgcaagctcctgcattttcagaccatgacttcgagataaagcataaaagagagtgtctacagctggaccaaggtcaagaatctctttaagatccgccatcggtagcgcctcaatacggccggggcgttcattcgccaaccagagcgcgatattttcagcagcctcaagggattcctttgtctgtttcataaaattgatcagggctttactggggctgacgttcaacgccggatcgactggggctgttgccctcggatgaagccggaacaagtaatgtacaaggtcaatgtgctcataagcgccgcatatctcaaaccatttgatgcaaagttcaggcgttagtgtggtcaggccattttcaacgtctgatacataccgttgatctttgccgccaagtaactgccctaattgaaattgagtaaatcccattgtctttctaacctctctcataatttttggtaaattatcgagtttatacgggttgttcgacatatgttcgcctcctgtttcacggggaattatttggtaaaatttaagtaatgaaggaactagctggcttgctgttttttcagcttattgatgatgaaggcttgtcccttcggagtgatgcgcattgtcagccaggatttcggcgtcccgtttacttggcgcaccccctgtgcgatctcaaagaaacctcgctcgatgtattcctggtatggctcattcttgttggccatgatcatcttccattcgcgcagcttctgaaacagtcgcttttcaccaatcatgatgccgtttttcgaagcaagctttgccagttctctcacaagcaatgatttttcggccgccatgcaactctgtgcaaagttgaccaatggttcctgaatcttcaatgcttgttcaagttgctgccgttcttcctgctcgctgatccatcgctttgcccggctgactggatcttcgatcatgtaggacggttgagtcattttttgaagctcggcttccatccggttaaattcagcaatgtatttttctttgaacactgctgcttttgcacccgtataaccaaaaaccaaaaatgcgagtccatcacgtttgatcagatattttttcaatgatcgtcctgttggatcttcatattcactcaacgaaaaatttcgttcagtaaaatctttagagcaattcagtgtttcaatgctttttattacatcggcgtgtcgttttccgaatacctcagccactgttaggctgtctgttacggcttggttgccttcaataaaaacaatttgattcatgctgttacctccttgcttgtccaccaaaaaaaggtgaagcagataattaagcgtgaagccttaattcttttttagaagtgaagtacggctcaagagctttacggaaacactcttctctgtccatcgttccgtaatattctttgcccatcttgatgtttgttgtttttttcttagtttgtttcgccatgtgatcacctcacgtcagtgtattcgtgttggacggttggactaaccaagaaattaagcagattcaagatccccattcttcatttcgtggcattcttcttcaaaaaaaagagtccaatcaaaatctaaaatgtttgcgatcttttttgcgacatgaggtctgacattcctttcgccagtctcaatggcaccataagttgatcttgcaatgccaactttgatggcaagttgttcttgcgttaaattggcatcttcacgtttttttctgagccagtatttcaattaggatgcctcctttcgttctacatatcgtggcttatgaatacatattaaaccacgatatgtagaatgtcaaacctttttattaaaaaacacgtaatattttcttcatttcgtggcatgtcgtttaattccacaaaatgtagagttataatgaatttagaatttacctttaaaagttagtaggtgatattatggcgattaaacataggctagtcgaattgaggaaaaagcaagggcctcatgtgaagcaagaagatgtggctaaagctttaggtatagcacgctccacttacggtgcttatgaacaagggaaacgcgaaccggaccacgctactctaataaagatagctgattattatggagtgactatagattacctactaagagatgagccagagaatatgaaaaatgaaatcttcaacgaacaagcaagaaagattcttgaagatcctgatactctggtagctgctgctgatggaaagataacagcttcaattttagaggcagctcaaagaattattgctgagcaattaaaatcaggtagacaacccggagatataaaaaacgggaacaaaaaataattacataacgatcgctttatctttatttattattattgtttagtttagtttagtttaattaatgctgaacacttcgcctcaaaatttgaggtaaactattcagttgaaaccatttcaacctcaatttttgaggtgatccatgaggttatttctgcattcaaccgcaaattttgaggtaaaacattcagggtttttcactcagattttagagagaaaaagtaaaaaaatcctttatttagacgatacaaagaaagagattgcacttcattataaaaggggaaattacaattgaaaaaatggttattaggtattggagcattgactcttagtttttctttagctgcatgtagttctgactcttcaagtagtaatgaaaaatcttcttcaagcaagacaagctcacttagtgctgaggaccagtttaaaaaagatgcaaaatcatatgcctatgaaaaagtaaatagcgccggcattaagaaagggacaaaaattgtcattgaaggcgatgttacttatgcagataacgtcaatgatgatggggatacagtttctaaaaatgttgagtttactgtaagtaaaaatagcgatggatctgaagtttacacagtaagcaataaaagcgctgataagttcaaactaaacgatacggttaaaatttatggtacatatgaaggcagagctgaaggaagtgcccttcctaaagtgaaagccgtttacgtcgataaaattgataaagaaaaagagcaagctaaacaagatgctgcactaaaagaacagtttgaaaaaactggcgaaggtgatattgaaggactgggccacgttaaagatatcggcgttggatataacgacgaagtcggaattgacggtaaagacactcctataaaacctgttacgatgggcagcatgaagctttatattaacagtgtcgacgttctcgaaattcaaccagatgatgatgcaaaatcactttattttaatgatcaagataaggttcgggctattgttgtcgatatgaaggccgaaaacacttcttctaaggacgtaacgtttgaccctaaccaagctgttattgttacaaatacaggagaacagcttgaatctgaaatgggattaatgggtgaagtaggcggagacttcttagggaaagttaaaaaagaaggccaggcatggtggatacttaaagataattcaaaagatatcactagtttgaaaatgattatttctcctccaagtgatgcaaaaacctatgatgatttaggaagcgagaaaagactagattttgatatcttgagttttgaagaagctaagaaaaaagattcaaattaaattgagcccctaaagggggcttttcttttcgctaaaaagagaacatacgtttgttcgccttcgacaaaataggtgataagatacaataaagcccatgataaaagtcacatctttggttatttaagggaggtttcatctttgagatacactaacagccatttagaagattggattgaacagctttacagggagatcaatattacaaagccacatgagattaattttgatagaattgctcaggccttggacatcttaattgtttacaatccggaaacgagttttgctctgcgattcaacggcatgtatacaatttctttagattcacgaaagacacgacaggaacagtggctggattttgctcatgaggtttgccatgattttagacacatgaacgatgataagatcatgcccgcttcgtggaaacgttatttagagtaccaggccaattattttgcttatcacttttgtatacctactttcatgctccgagcaatggacatcccccgtaatctatacgacgcagttcaagtcattgccgatgccttcaaggttccagagtcatttgcgatgacccgcatcaatatgtacttcaataaaaaacgactcatcatataaaaaagagcctctaaagggctctaagtttgcgaccggtatgcataccatttgaaatatggtttcgaacggttttctcactgataaatagctcgcttgcaatctcctttgttgtcttatcttgaacgagcaattcgaacacttctctttctcttttcgttagcagcggcttcgattgaaattctttctccttcaagtattgtaaccctccttgctaaggtgagagcgaatcagaaacgaatgggttttgatatagtcgagatatcatatgtaagaagggcgcaggaggtgacgtttacaagataattagtttatcgtgtatgaagaagcgtttctttctcctcatctgtccagctgacagctttgccgctttcctttgagacttgaaccatcacgactgccccggtgaagcagggttcgccttcgaggttctctccgagatagtgcaaggtaagagatgaactgccgactgcgcttgttttcacatagatgcgcaactcttcataaggcatgacttggcgcaaataatcgcattgctggcttgccacgactgtcatggtctgtttgttttcactcatcatattcagctttttaaaataagaaatccgcgcctcctcaaaatatataaaaggggttacattattcatatgcccaaacatgtctgtctcggaaaatcttacggatacctcattgaaaaaagaaaaggatgttttccattcttgaaacggcatatcaatataagcgggaagcttcatcttttttcatctccttattgtttaaaaaaacctctcccatgcggaagaggttttttcttcttatactctgtcgcttccgaagaaattgcggaacgcttgtaagtttgtatctctattcaaggctgcaatcgaagtggtaagcggaatccccttcggacaggattgaacacagttttgcgagttaccgcaatctgcaaggccgccttcatccattaatgcttctaatcgttcagatttattcatggcgcctgtcggatgcgcgttaaacaggcggacttgcgacatcggtgcaggccccatgaacttcgatttgctgttcacattcgggcaagcttcgaggcagacgccgcatgtcatgcattttgataattcatatgcccattgacggcgtttttctggcattctcggccccggtcctaaatcgtacgtaccatcaatcggtatccatgctttaacttttttcaatgaatcaaacattctgctgcgatcaacctgcaaatcacgaacgactgggaatgttttcattggttttaaacggatcggctgttcaagctggtcaataagcgccgtgcaagactggcggggttttccgtttatgaccattgaacatgcgccgcatacttcctcaagacagttcatatcccatgtgacaggggttgtcttctcacctttgacattaaccggattccggcggatttccatcagagcggaaatgacgttcagattcgggcggtatggaatctcaaattcttcatcataaggcgtgctgtcagctgtatcttgacgtgtgataataaatcgtatggttttttgttcactcatgattatttcgccaccttcttcttcgagtaatcccgtttccgaggcgttatcagtgatacatcgacatcctgatactcaaattccggcgcttcatacgggcttacatgtttagccattgttgttttgagccattcatcatcattacgttcaggataatccggtttataatgggcgccccggctttcattacggttgtatgcgccaagggtaatcaccctagcaagctgaagcatgtttgagaactggcgtgtgaacatcgctccctggttgctccattttgtcgtgtcattgatgttgatctttttgaagcgctccattaactcctgaattttgtcatccgttttcaaaagcttgtcattatggcggacaaccgttacgttcgccgtcatccactcaccgagctctttgtgaagaacataggcattttcggttccgtccatactcataatatcagcccatttttcttcttctttcttaacgtgagcgtcgaataaagatgaagacatgtcttccgctgaagattctaagccgtttacatatttcaccgcattcggaccggccaccatgcctccgtaaatcgcagacagcagggagttcgctcccaagcggttgccgccgtgcatagaataatcacattccccagccgcaaacagtccagggatgtttgtcatttgatcgtaatctacccataaaccgcccatagaataatggaccgccgggaagattttcattgggagcttacgcgggtcgtctcccatgaatttctcataaatctcaatgatgccgccaagcttaatatcaagctctttcggatctttatgagacagatcgagatataccatgttttcaccgttaatgccgagcttctggttcacacacacatcaaatatttcgcgtgtcgcaatatcacgcggcaccaggtttccgtatgccggatatttttcctccaggaaataccatggtttgccgtctttatatgtccacacgcgcccgccttcaccacgcgctgattcactcatcagtcttaatttgtcatcgcccggtatggctgtcgggtggatttgaatgaattctccgtttgcataatacgctccctgctgataaacgattgatgcagcagatcctgtattaatcatggagttcgttgattttccaaagatgattcccggtccgcccgtcgccataatgacagcgtctgaacggaaggattcaatttgcatgtttgtcaggttttgtgcaacaattccacggcaggttctgtcatcatctaaaacagcgccaaggaattcccagccttcgtattttgtgaccagacccgcaacttcgtatctgcgcacttgctcgtccagtgcgtaaagcagctgctgtcccgtcgtcgcaccagcataagcagttctgtggtgctgtgtacccccgaatcggcggaaatcaagcaggccttcaggcgtccggttaaacatgacgcccatccggtctaataagtggatgattgaaggcgccgcttcacacatcgccttgaccggcggctggttggcaagaaagtctcccccgtataccgtgtcatcaaaatgttcccacggagagtcaccttccccttttgtattgaccgctccgtttatgccgccttgcgcacaaaccgaatgagaacgtttgacaggaacgatggaaaacaacttaaccgccattcctgattccgctgctttaattgtcgccatgaggccggcaagacccccgccgactacgataatgcttgattgactcatgatagcccctctccctctagtaatctagtactcttaaacaaatgcgaaaatcgcttttaagcctacgtatgacagtgcaacaaaaataatcagcgtaacgtatgtcgaaattctttgagaacgaggcgttaccgtgatgccccatgtaacagcgaaagaccataaaccgttcgagaagtggaaaattgttgataaaacaccgacaatgtaaaaaccaagcatagccggagagctcaaaatattcgccatcatgtcgaaattgacctcagcgcccatttgtgcggcaatgcgggtttcccacacgtgccagctgacgaaaatgagggtgatgataccggttacacgctgcaggacgaatagccagtttctcatgtagctgtattgacctgcgttatttttcgcagtaaacgctatgtacacaccataaactgcatgataaattaatggtaagaagataataaaaatttccaaggcatacctgaaaggcagactatccataaaatgagcagcgctattgaatgcttcagcgccccttgcggcaaactggttgacgactaaatgctgaataagaaagatgccgaccggtatgacgccaagcaaggaatgcaatcttcgaaaataaaactctctgttcccagacattactttaccccctgtttgataagtgcgaaatgtgctaaatctcttcccccacttctttcaattgtaagcactttattaagatttattgacaatttcattttactcctccctcaaaagggcgtcaagaaaacgcgtacataaattataattttccgaattggttagttgattgaaaaattttattttatcaatatatatttcttacttaatttttcataagaattacaggatcattctgtaatcctcccccctgtttgagctataatatacgcaggagagaggggagacagatatgaagtctaaatttgaagcatctattgacaacctaaaagaaattgaaatgaacgcctatgcctacgaactaatacgagagatcgttctcccagatatgcttggccaagattactcttccatgatgtattgggcaggaaaacatctcgcccgtaagtttcctcttgaatcatgggaggaatttccggccttctttgaagaagcgggctggggaaccctcaccaacgtaagcgctaaaaaacaggagcttgaatttgaacttgaagggccgatcatttccaaccggcttaaacatcagaaagaaccttgctttcagctggaggctggttttatcgctgaacaaattcaattgatgaatgatcagattgccgaatcatatgaacaagtgaaaaagagagcggataaagtggttctgactgtgaaatgggatatgaaagacccagtgtaatcaaaaaggcggtgactgcatagtcccgcctttttgattgtcattacacagctgaagggtgttttgaaagctcaaatgcatcgtgaagcgactcgactgctttcaccatgtcattttcgcttacgactgttgacactttgatttcagatgtgctgaccattttgattaaaatgtttttttgcgccagtacagcaaacatttcagccgctacaccgggatttgagaccatgccggatccaacaatggatactttagccaatttgctttctgtctcgattttctcaaattccagcgcgtctttatactcttcaagcaccgcaacggtttggtctgcatcttctgttttgacagagaaggaaattccagtcttgtcctcggcctgcgtttggataatgatatccacgtttatgtttcttttggcaagtgtcgtaaaaatagtagacaaagttgtcaagccgctagtcagcccgtaaatggttactcttgtgatttgatcttcaaatgcaatgcctctgacaattaaattctgttccatggatgattcctcctcaattaatgttcccgcttcggtttctgtacttgaacgcacttctaacggcacttggtaatttttcgcgaactcaactgctctcggatgaagaacgccggcgcctaaattggcaagctcaagcatttcatcgtatgagatgcccgcaagttttctcgctgatttcacatagcgcggatcggttgtaaacacacctggcacgtctgtgtatatgtcacatttatcagcttttaaagcggcagccaaagcaactgctgttgtatctgaaccgccccggcccaatgtcgtaatttcacaatcctctgtcattccttggaagcctgcaacaatgacaatttttcctttttcaagctggtctgctaaaaccgaagtgtcgatatctgtaattctggcgtttccgtgaatggcctccgtacggattcccgcctgccagccagtataagacacagcgtcatagcctttttcctgcaatgccattgaaaggagtgaaatcgtgacctgctcgcctgtcgccagcagcatatccatttcgcgtttgctcggctggtcagaaatagcttttgcaaggctgaccaattcgtcagtggattttcccattgctgaaacgacgacaacgacttgatggcctttctgtttttctgcaattgcgcggtttgccgcattttgaattttttcgactgagccgacggaagtgcctccgaatttttgtacaataagacccatgtattaccaccctttacattttggttcgtgcgggtgaggagaaagagcgctttgtccacaataaaaaaagcaatgagaggaatactctcattgcttatcaattaatcatcataaatgattatgaacaacgagatagccctccaagaaaatgatttcttgacagccttacatttattcaatgcacggccagcaaataataccgatggggttttatttgcttcggcgacgctcccctttcagcctttttcacagaatccatctttctccaaaggcatactcttgaagttcgcacctctatcttcaccatataacacgatctaactatgaaattagttcacattttatcagatcttatttaaaaggacaacattatttttgcaatttgtcgtaaaggagctgagccgccgctgcgggaacaccggcttttttgatgtcctcaaggcttgcttccttcatttttttaacggaaccgaaatgctttaacagcattttctttcttttctctccgatacccgggatgtcgtccaaaacggattgaaacgcgctttttccgcggatttgcctgtgaaaactgattgcaaaacggtgcacctcgtcctgaatgcgctgcaggaggtaaaattcctggctgtttcgttccagatacaccacctccagcggatcaccgatcagtaaatttgaggttctgtgtttttcatctttcgctaaaccggcgatcgggatatccaagccgagttcattttcaatgacatcccttgctgcgttgatctgcccttttcctccgtcaatgataatcagatcgggcagcggcagattctcacgaagcactctcgtatagcgtcttctgacaacctctctcatagaaccgtaatcatccggccctgtaacagttttgattttatatttgcggtattcctttttgtatggtttgccatcgataaacacaatcatcgcggaaaccgggtttgtcccctgtatatttgagttatcaaacgcttcaattctgtgcggcgtataaatatttaatgcctcacctagtttctgcactgccccgattgaacgctcctcgtcccgttcgattaaagagaatttttctttcaatgcgattttcgcatttttatgggcaagcatgagcagttcttttttcgggccttttttcggctggtgaacgtttgtttccagcagctgctcgatcatagattgatctacgctgtccggaactaaaatctccttcggaaggaagtggttgttttttgaatagaactgcccgatgaacgtgaggaactcttcatctgcttcctgataaagcgggaacatgctgacatcgcgttcaatgagctttccttggcggatgaaaaagacctgcacgcacatccagcccttatcgtacgcgtacgcgaacacatcacggtcgactagatcgttcatcgtcattttttgtttttccatcgttgattcaatatgggccatttggtcacgaagctcttttgctcgttcaaactcaagattctcagcagcttcatgcattttctcttcaagctcttttttgacctcattatagccgccccttaagaaacgtgtaatgctttcaaccagctctctgttcgtctcttcggaaatatcctttacacacggagcgaggcattggcccagatgatagtaaaggcacactctgtccgggagcttggagcattttctgagaggatacagacggtcgagcagtttttttgtttcccttgctgcctgtacattcggatacggcccgaaatagcgccctttgtcttttttgacattgcgggtgacaatcagccttgggtggcgttcatgggtgagttttatgaaaggataggttttgtcgtctttgagcatgacgttgtatttcggatcatgctttttgatcagattcatttctaaaataagcgcttcaagattggaggacgtcacgatatattcaaaatcctcgatttccgtcacaagcctttgggttttcgcgtcgtgagaaccggtgaagtaggagcgcactctgtttttcagcacttttgctttccctacgtagatcacagtctgctgccggtccttcatgagataacaacccggttgatcaggaaggagggcgagtttttctttcagttgtttgttcatatgttacccttccttatgtttaatcctttatttccagtttaacacgaacgtttgtttttctctatggttcacaattggcgaataaaaaaagcgatccctcaatcggaatcgctctggcatgtaagcagcggaaaattaaagatgtttgtttacaagctcttgaagcgcttcttttggtttgaagccgactgaagtttcaactacttcgccgtcttttaacacaagaagagtcgggatgctcataacgccgtattttccggcagtttcttggttttcgtctacatcgatttttacgattttcagtttgtctcccatttcttgatccaattcttcaagaacaggtgcaatcattttacaaggtccgcaccaaggagcccagaagtctgccagtacgacgccttcgcttgtttcagctgagaaagattgatcagttgcttttacgatagccattattgaattcctccaatgtgaaatgatgatttttagtatagcatctcccattcgttcacgctattttaatgcttacaaattattttttcctgatcacagccggtttactcatttttatatggttgaatgggatatgctctttttttaaaacacaaatctgataatggccccaatcactacaattgccccaataatcattaaaatggtacgaagcataagatcacatctcctcttcactgtcatgtactttaccatgccctgccggagctgttttaaaacctgaaaaagagcgccggcatgaagctccggcgctcttgcgcgattaagaatcagcacgcagcgtaagcaagacgactgacattggcgggagttttactttcagtttgtttttgctgagcgtgtattgcctgaaggattccggtttgacatgatgaggatcgtcaaacgtgttatgcgcattcattttttctgccgtaagaatgactccggaatggtccgctgccttgtgtaggcccctcagctcgatttccgcctccgctttgttttggtgatcgatgttgcaaattgtgatattgatatcgccttcagtttgtttcgacgctgaaatgctgatttgcggaagcgtttcaccgttccattcatagtcggcagacattgtctctgtggctaaaagagaagcgtcctggtgcaccttaaacatattgaatacatggtacgtcggtgtcaaaagcatccgctctccctcagtcaaaatcatcgcttgaagaacatttactgtttgggcgatgttggccatttgcacccggcggcaatgctgatggaaaatgtggaaatgagaagccgccaccagtgcatcacgaatggtgttttgctgatataagaaaccgggattcgtgcctggctcgggatcaaaccacgtgccccattcatcaataatcagcccgacccgctgctccggatcgtaccggtccataatcgtgccgtgtttttgaatcaattcatcgatgtatttggcttttttcatcgtaataaaccattcatcttccgtgaattctgtggctgatcctttgcccttccagaaatcccccggaatcgtgtaataatgaagactcaacccgtccatcaggccagcggcttttttcataagcacgtccgtccaattaaaatcatccacatttgcgccgcctgcaattttataaatgtcattcccgctgtaattgcggacataagtctgaaaacgccggtacagatctgcgtagtattcgggatgcatgttgccgccgcagccccagttttcattgcccacgccgaaatatttcagcttccaaggctcttctcttccattttgctttctccagtctgacatcggcgtgccttcttcaaatgtcatatactcaatccactccgccatttcctgaacggttccgcttccgacattgccgcaaatatatggctcgcattcaagcagctcgcaaagcatcataaattcatgcgttccgaattcatttgattcaattgtaccgccccagtgagtgttcagcattgtcttacggtcaccgacaccgtttgcccaatggtattcgtccgcaaaacacccgcctggccacctgaggacagggatgtgcagctgtttgagcgcctccagcacgtcctttcgtatcccgttgatattggggatgtctgagtccgttccgacccagatcccctcataaatccctcttcctaaatgctcagcaaaatgaccgtatatatttttgttaattgttccttttacgatatctgtttgaatcactgcttgatgttcagacatgcctctgatcattcctttcatacggatatgaaaagcaccacagtcaaatatgtgatctgtcttttgcctgaggagtcagcatgaatgtaagcgcttttaaagtaaccatattatatatgttcgtacatgtcaacgacattttctattgtttttatatttgtacgtatgtatttataaatatgaaaaaatcccgaacttttaaagtccgggatttcctttatgagtgtatattcaattgtttgaattcctcagttaataacgggacaacttcaaataaatcaccgacgatgccgtaatccgctattttaaagatatcggcttcggggtctttattgatggcgacgatcaccttgctgtttgacatgccggccaaatgctggatggcgccggaaatgccgcatgcaatgtacaaatccggagtgacgactttcccggtctgcccgatttggagagcgtaatcgcaataatcagcgtcacatgccccgcgagaagccccgactgcggcccctagcacctctgcaagctcctgcagaggctgaaatccctccttgcttttgactcctcggccgcccgcaacgataatttttgcttcggagagatcaacgccgtcagctgtttttttcacgacctcttggataacagtgcggaggtcagtaagagaaacatcaatgcttttgatgctccccgatctgctggtgtctttttctgaagcttgaatgttattggggcgaattgttgcaaagatcatcggatcggttgaaatgacgcgttcaaaagctttccccgagtaaatcggccgtgtgaacacaacattccctccggtaacgcttacatctatagcatcagaaattaagcctgtttgcagccgggcagcaagcttcggtgaaagatccttgcccattgccgtatgcccgaagatgactgaatcaggattttcttgctcgataacacctctcatgacctggctgtacccgtctgccgtgtatgttttcagcttcgggtcctcagcggtaagaactttatctgctccgtaatgaataagctcttgtgcaatgctttgtacattttcaccgatgagaacaccgatgacttccccatctcctgaaatggttcttcctgcagctattgcttcaaaggtgacattccgcaattccccatcgcgtatttctccaagcacgatcactttttttcccattctaacatccccctgtttctttgaatgtccaagctttaaatgactttagcttcgctgcggagcaatgaaacaagctcttttgcctgttcagcaggctcaccttggagaagcttcccggcttcttttttcggcggcagaaaacgttcaatggttttcagctttggttcagcatcctcttcgtccaggtcaagatcatcaagttcaagctcttcaagcggctttttcttagccttcataattcccggaagcgatggatagcgcggctcgtttaagccctgctgagctgtgacaagcaatgggagcgtcgttttgattttttcaacatccccttcgacgtccctttctgcttctgcatcagtgccgttgatttcgagtttggtgatcgtagtgatacacggaatgtccagcagctcggcaagccgaggcgccacttgtcctgatcctccgtcaatggcaacatttccgccgagaatcaaatcaaactcctgatccttcatatagtggtataaaacttgagaaatggaatattggtcgggttcatcaagatcatcttctatgttgattaaaacagcttggtcacaacccatggcaagcgccgtacgcaattctttctccgcttcttcaccgccgaccgtgacagcggtgatcgtgccgccatgcttttccttcagctggatggcttcttctatcgcgtactcatcatatggattaatgatccattccgctccgtcatcctgaatctttcctgtttcaatgacgattttttcttctgtgtcaaacgtccgtttcatcagtacaaatagattcatgatcatatccccttttattcgcctttgaactgaggctttcttttttcgagaaatgcctggatgccttccttggcgtcctctgactcaaatgcttccccaaatcgctttgcttcaagctttaagctgccttcataggaatacaccttgttggaataaagaagttcaagcaaagatgccagcgtttgcgggcttttctctgcaaacttagcggcaagtgcttttgctttttcaatcacttctgcctcatctttcgctccaattgaaacaagtccgagatcaagcgcttcttttccggatatcggttctcctgatccgatgagctccagtgctttggctgtaccgacatatctcggaaggcgctgtgtccccgcaaaacctggaatgataccgagattaagctccgggagccccagcttagcatcttctgccgcgattctgatgtgacaggccattgcaagctccagcccgcctccgagagcagcgccgtgaatcgctgcgataatcggttttggaaaactttcgattctctccattaactgctggccgcgctcagcgagcaatgaggaatcctcattgcctttaagcgatgtaaattctttaatatcagcgccggctgagaaaaatcttccctcgccgtgaatgataatgcttcgtacgcctgcatctgtctcacattgatcaagacaggaagacagctcttctaatatccggcttgaaagcgcgtttgccggcggattgtgaatcgtcaagactgccacaaattgatcaaccgcaagtgaaattgcattcataggacagaactcctttacttattgtgaattccggataccaataattctaaaacgctgtttgaaagcgcaacgagatcgtacttttggtcattcatcacccaagttgtcacagtttcgtcaatcgttccaaaaatcatctgccgggcgaggcggacatcgaggccttcttttatttcgcctgattgtataccttccgtcaaaatgccatccaaaatatttaagtagccttttaatatttcgttgattttttggcgcagctccaagttggattggcggagctcaagctgcgtgacaatcgcgagattatggtcacccgctaaaagggaaaaatgctttgaaatcacaagcgccaatttctctttcgctgttgctttttctttaatgtcctcttccatccgctcaataaattgacccattttttctttgaaaagagaaattaaaatatcttctttgtttttaaaatagagatagatggtgccgtccgctactccggcttgtttggcaattttggatacctgtgactggtggtagccgttttctgcaatgacttctactgctgcatcaataatctgcatatactttggccgtttttgcttcaatgttcatcgttccttcctacagaaatgaatgactattcattcataatttcatgataagaaggattttcaggtttgtcaagtttattcataggcgttctctttttttatttgatatgatgattttcggtttcttcttcaagtaaacgccttcttaaaatttttcccaccgccgttttcggcagctcttttctgaactcataggctttgggcaccttatagggagctagtcgagatctcgcaaaggcatccagttcttctgcatcggcttttgcgcctttctttaatacgacaaatgcttttactgtttctcccctgtaggaatcgggaacgcctgcaacaacaatttcctggatggcttcatgttcataaagcgcttcttctacctcacgcgggtaaatattgtaaccgccggcaatgatgatatccttcttcctgtcagcaatatagaaaaagccttcttcatccatatagcccatgtccccggtgaacagccaaccatctctcagcactgcggcggtttcctctggtttattccagtatcctttcatgacttgcggaccttttacaatgatttctccatgctcatacggagcggcaagctcacccgtctcttcagaatagatcgcagcgtccgtactcggccaaggacagccgatactgcccggcttgttttttccccagataaagttggcgtgcgtcactggggatgcctcagacaaaccatagccttccacaagctttccgccagtcaccttttcaaatttctgctttacctccacggggagcgcggctgatccgctaagacagcttttaatggatgacagatcataatgctgcaattcggggtgatgcaaaaggccaatgtaaattgtcggtgcgccaggaaagagcgtcggtttgtgtttgtcgatgattttcagtgtttcgagcggatcaaacttaggaagaagaatcatttcgaagcctagtttaatcgaatagttcatgactgccgtcagtccgtagacatgaaaaaatggaacgatgcccagcactttttcagcgccttctttcacgtcatacatccaagcggcgcacatttcagtatttgccaaaatattttggtgcgtgagcatgaccccttttggagctccggttgttcctccggtatactggaggacagcgatatcatgctcaggatcgatcttcgggattgtcaggagttcagttttttcctgcttcatactggaagcgaacgtgtgaatgttagctgttttgtcaaagtcgatatgcactttttgtttttgcgtcagcgggtaaagaatattcttcggaaaaggcaaatagtcttttacgctggttatcaaaatctggtcaactattgatagcgttttcatttttattgccttcgggaaaagcaaatctaaggtgatgattacacttacctgagcatctctaagctggtattcaagctcatgctcggtataaagcggattcgtctgcaccacgatgccaccggcaaacaagacgccataataagaaatcactgtttgcgggcaattgggcagcataacagccactctgtctcctttttgcaggccattgcactgcaaaaaagctgcaagtttaagagcatccgtcagaatgtcatgaaaggtgagtttttttccataaaacgatattgcggttttatcagggaatcgtgcggcggagtctgtcaggatggattgcagggttttattcggcaacgggagctcatgcgggatatcgttgggatactcggcaagccacggcttttgagactgcataaaacctccccctttcgattttagagttccaccttatcattatagcagatggacggcaaaaaaaagaaaaagaaaggtaaatctttctttttctcataatatgaacagatatataagaccaattaacaaaaagattcccgccgcggcgagcagtacttttgcaagcttttccatttattctccgtccccttatattccggctgccaccacaaatgaaagcccgacagaaatgacaaatgaaataaagccgacagcccggttatcattttcgatttcctgatcaattttaaaccgcggagtcaaaaactcaaaaataaagtagctgatcagaagcataacaaacccgtaaacgccccagccgatcatttgcagcagcgaattatgctgggagatggaatgctgaaatacgtttgcgatccccaaaatttttccgccggtcgccattgccaccgcaagatttcctttttgaatctcttcccagtttttataagccgtcaccagctcaaacacagtcaaaaagaggacgaggcagagaaccgcgacactgtaatatgccgcgatttccacaagctcgttttcccaaaaatcactcatggccatactcccttttattttagttcaacaaccgtaacgcctgatcctccctcacctgcttcaccgaaacgggaacttttgacgctgcggtggtttttcagaagatcctgtacgccttttcttaaagcgccggttccttttccgtggatgattgacactcttggatatccggctaacaccgcatcatccaagtatttttcaacccggcttagggcattttcatagcgttcgccgcggagatcaagttcaagcgatacgtgatagtcctttcccttgaccgctgtaatgattttttctttttttggctccggagctgatttgataaactccagatctttttcttttactttcatctttaaaataccgatttggacattccattcattgccgcctgttttttcgagcaatgttcctttttgcccgaaagtgaggactttcacctcgtcgccaggcttaaagtcgcgtttttgcgctttcggcttctccggtttcttggacttttcaaaagccggcatagcgccttctaaccgtttcttcgcgttaatcagctcgtgatccttgaaggatttgtgttcttcttttatggagcgcaattcatgaataatgtcctcggcttctttcattgccgcttttactttttcagcagcctgctgttctgcctcttcaagcattttgtcttttttgctgttaagctcgatgatttgctgctgcagctctttatgcagtttttccgcttcttttctgattgattctgtctcagaaagctcttcttccgcacgttttttgctttgttccagcgacgcaatcatcgtatcgacttcgttatgctcggccgtcatttctgacttcgcctgcccgatgatatggtccggaagcccgaggcgttttgaaatttcgaaagcattgcttcgacccggcacaccaattaaaagtttataggtcggtgacagcgtttcgatgtcaaattcaacgctggcattcatgacgccttctctgttatagccgtacgccttcaattccggataatgcgtcgtagctaacactcgtgcattggtgcgatgcacgtcatccaagatgctcatggcgagggccgccccctcctgcggatctgtccctgcaccaagttcatcgaaaagcacaaggctgttttcattgacctgttctaaaatgccgacaatattcaccatatgggatgagaacgtacttaaactttgctcaatcgactgttcatcaccgatatcagcgaatacgtgctcaaatactgccgcttctgacccttcatctgccgggatatgaagacctgactgcgccattaaggttagcaggcctaacgttttaagggtgactgttttccccccggtgtttggccctgtgatgacaatggttgaaaaatcgcggccaagctcgatgtcattggcaacaacttgatcaggcggaagcaatggatggcgggcttttttcaaacggataaagccggtgtcgttcataatcggttttgtcgctttaaccgcttttgcatatctagcttttgcaaaaataaagtcaagcgtctgcagcacttgcaaatctagaaatagttcctctgtatactctgccgttttctctgtcagcacacgcaaaatccgttcaatttcttgcttttctttcactttcgcctgctgaagggaattgttcatatctacaatcgcctgcggttcaatgaatagtgtcgcaccagaggatgaggtgtcgtgcacaattcctccatagctggatctgtactcctgtttgaccgggatcacaaagcggtcattccgaatcgtaacaatcgtatcagacagcattttcgatgcggaagaggaacgcagcatcgactctaaccggtctctgactcttgattcgagtgttctgagctgtgtgcggattcctcttaatgtttccgatgcatgatcaagcacttctccgtgatcatcaatgcaggaattaatgtcccgctctaaatcggacagcgtgataagctgttcagcatgctgatggatcagcggaatgtcgacaccgtcttcagccatttgggtgataaaatgtttcatttgtttaactgcataaagcaggcctgagatttcagtgaattcagaaggactgagaacactgccgatttccgcccgtcttaacgctcctctgatatctacaaggccgccaaatggcgcttggcctctcagccggataatgtcagaagcttcgtctacttcatccagctgttttttgatttcgtctatagaagcagaaggcttaagctcgagaagcatttcttttccgagcgatgaagcggcatgcccaataacctgttctttcactttatgaaattcaagagctgataatactttttgctgcacgattgtgtgagcctccttacttaatcgttgcgcttcagaaatgcctctacgtctttaagcgaccgggcattcagaacgtttttcgtttccgtccatcctttgcgcgcggcagtaacgccagttttcatatcgtctaacatctcaatattatgggcatcagtattaatcaccaatgtaaccccttgttcgtttgctttcattaaatgctctgtgcgcagatcaaggcgcgcagggttggcgttgagttcaagcgccgtatttgttttcctcgcaagctcaatcagctgatcaatatcgatttcgtaaccggcccgtctgccgataaggcgcccggtcggatgtgcgataatgtcaacatgcttgtttgtcagtgccgtctcaagccgtttcataatcacgtgttccggctgattaaaactggaatgaatcgatgcaataacgatatccatttccgcaagcacatcgtcatcataatcgagcgtaccgtcaggcaggatatccatctcaacgcctttcaaaatacggaagttttcaaactctgcattcagcgcgtcaatttcttttgcctgctgcttaagtctttctgcagtaagcccgttggcgacctttaaatattgtgagtgatcggtgatcgccatgtattgatagccttttttgatgcaggcttcagccatctctctgatcgaaaatgcgccatcgctccacgttgagtgcatgtggagatcacctttgatttgcccgagctctatcagttcaatgctgtcgctgtaggtttccacttcctgtccgctttcacgaatttccggcggaatcagcggcaggccgaagtgcgcataaaattcacgttcactcggaaatgttttgatctctccggtttcaactgtctcaacgccgtattcactgatccgctcgccgcgttctttggcgatttggcgcatcttaatattgtgatcctttgatcccgtaaaatgatggagtgttgtcggaaactgctcttccgtcacaagacggaaatcgacgcttgtttcatattcaaaggaaaggatgacggacaccttcgtatctccgcttgcgattacgcttttgatgtttggcagctcaagaagctgctctcttacttcagccggatgatctgtagcaatgatataatccagatccttcaccgtttcccgcgctctgcggagacttccggcacgagaaaatttgatgatatgcgtaaattgagaaagatgctcctcaatttcccgcgcgatccggagggcgtatccgatcgggaaccgttcaggctgttttccggcttccccgagcgcctgtaatattttttcttccgattttttgccgaagcccgcaagaccctggaccttttgctgctcacaggcttccttcagagattctgcatcgtgtacgccgagctctttatacagctttgcgatttttttgccgccgagccccggcagcttcaataaaggcacgagtccttccggcacttctttctgaagcgattcgagcgtgcttgactttccttcatctatatactctttaatgacgctgtacgttccttttccaatgccggacagcgacatcatatcgtccatttctgataagcttcggtcgtcctgttccaaggctgccgccgcttttcggaaggcagatactttaaacgggttgtcccccttgagttccatatagactgcaatggtttcaagcagccggataatatcttttttatgcatatcataaccccagacgttcacatatgtttccatcatacttgaaaaaaacttctccggacaagagaagtttttttatgccccgtactgtgtccacagctcttgtaaaagccctgacaagtacggtgtatggttaatgatcacatttgcgagagacgattgtcccatcatttgctgcaacgcatctaccggcagaacggatgcgacatacagcagcacaaatgtaaataaatagacttctagaaaaccgagaacggctcccagcatctggttgatttgtttaatcaccggaatgccggctacaatactcaggaacgagccgatgattctcagtaagattttagcaatgataaataaaacgataaacgcaatcgcattatagtacgctgcttccaaattccccgtaaaaaaagaaagagccggctgtcccgctgaaaaatcgggtgcgggaatccaatgtaaatgcggtgccacgtttttatagaataaagccgcaaaggcaattgataaaataaagctcgtcaagcggataaactgcaggataaaaccgcgttttaaccccagtaaagtccccatcaggagcaagattaagatgatgatatcaagcatagttgttcaatccttttctttaagctgacgctccagtttttcacatttctcttgtaatttgacataatcgtgcaccacatttaccgctgtcagcactgcaagtttatttatatcaaggtatggatttttttcattgatttctctcattttatcatcaacaattccggcgacatacctcatatgggctctgctttcttcaccgacaatcgtgaagtgctggccgtaaatgtcaacggttgtttttgtttttttgccgtcagacaacgtttctcctccattccgcgagaatcctagttcttatcataacacgtttattaaatgaatggaaagacgagcctcccgctgttatgatacactggtatatacagcgaaaagtgtaaaaaaaggagattattacgtgtcccattcagtgataaaagtatcgttgtctgctattgaccaaatgaaaatgacgtacagcggttcacttacagcctctgttccgcagggagccgtttttcaggcaaaaccgcccggctgtaccattacagcatataaatcaggcaaggtcttgtttcaaggaaaaaacgctgcggcagaatccgcgcgctggggaacagcagagcctcaggaaaagaagaaaacggccaaaaagccggctgatccccgctatgcccctccggcagatatcgccggaatgtctgttatcggttctgacgaagtcggaaccggagattactttggcccaatgacggttgtatgcgcgtacgtcgacaaaaccatgcttcctttaatgaaggaactcggtgttaaggattctaaagatttaaaagatccgcaaatcatcgagattgcccgaaacctgatcaaaactattccatatagcctgctggttttaaaaaatgaaaagtataacagcatgcaggaaaaaggcatgagccaagggaaaatgaaagctttgctgcacaatcaggcgatcacacatttattaagaaaattggatggagtaaagcctgaagccattttgattgaccaattcgctgagccaggcgtctacttcaatcatttaaagggcagagacattgtgaaggagcggacctattttagcacaaaagctgaaggtattcacctggctgtcgctgctgcttcaatcattgcaagatattcatttttaatggaaatggataaactatcacgcgcggcaggaatgacgcttccaaaaggggccggtccgcacgtcgatgaagcggccgccaagctgatcctcaaaaaaggggcatctgcactcagaacctttacaaaactccatttcgccaatacgcaaaaagcgcagcgccttgctgataaaaaacgttcatagaaaaaagcttgcagatttctctgcaagcttttttctcagcctcttaaaacagcttgatatgtgtcttctaacgctttcagcactttgctgtgcgcctttgtcacttcttcttcagtcagtgtttgttcagggttgacatactggagtgagaaagcgactgacttcttgccttcctccatatgttcgccttcgtatacgtcaaagacggttacctctttcagaagcttgccgccagcctctttaatgacgctctcgagctgtccgcttgtaacggttttatctgttacaagggcgatatcacgtgtcacagacggatatttcggaatcgccgtgtaaacaagcggtgctgtttctgctgcgagcaacgcatgaagatcgagctcaaatacgtatgtttcctttatatccagttctttttccaatgaagggtggacttggccgatgaagccgatcagagaaccattcaataaaatgttcgctgttctgcccggatgcagctgtttgcgttcagactgtacaaattcaatgctgtctaggacgttgagtttgtctaacagcccttccacaattcctttgacaacaaagaaatcaactggtttcttttcaccctgccatagctgcttgcgccataatccggtaacagctcctgctacgcgttctgtttcaacaggttttgtgtcctcttccttcgttaggaaaacggagccaacttcgtacagtgcaactgagtcagtctgcctcgcaaggttgtaagaaacagaatcaagcagattcggaacaagactgtgtctgagaatgcttctttcttcactcattggaagcgcaagcacagtattcagtgatttttcaatcgcaaacgctgccgctttcttctcgtttgtcagtgagtaagtgatggcctgtgataagcctgcgccttcaaggaagcgtctgactttacggcgttttgcctgatatggcgttaatccgcctgtagttcccgctgtctcaggaagcgtagacggaatgttatcgtagccgtacagtcttgccgcttcttcaattaaatcctcttctattgtaatgtcgccgcggcgtgatgggacagtcacaacgagaagttcatccgcttcaccgaccgtaaaaccgagacgtttataaatgctgatcagttcttctttactgatcgtcaggcctagaacgctgctcactttgtcagcagatacgtgaatgttatttgcttcgattgtcaggtgatcttcctcaactgttccagcaagcacctcaccgccggcatacagatggatcatctgcgcagcccgttctgctgcaagacgtacgcgcgccggatcaattcctttttcaaatcttacgcttgattcacttctcaaaccaaggtctttggaagccttgcgaaccgtctgcccattgaaatacgcagcctcaagcaaaatcgttttcgtatcttcctgaacctctgactctgctcctcccatgacacccgcaacggcctgcgctttcgttccgtttgtaatgacaaggtgatcggcggacagcttacgttcttgatcatcaagagttacgatcatttcattctcagctgcttttcttactacgacttccttagagccaaatctgtcataatcaaacgcatgaagcggctgtccgtattccaacaggacaaaatttgtgatgtcaacgacgttgttgtgcggacgaatgcctgcattcatcagctttgtctgcatccaaagcggtgacggagcaatcgtgacatttttaatgatttttgcagtgtacagcgggttcgcttcttgatcttcaattttgactgaaatgtaatcagacgcttgttctgaagcagccgggtaatccgtttgcggaagctttacctcagtgtctaaaatcgcggcaacctcgtaagcaacaccaagcatgttcatggcatccgcgcggtttggcgttaaacccagctcaagaatcgcatcgtcaagctgtaaagccgctaaggcatcgcttcctgtttcagcgtcattagggaatacgaaaatgccttctgcatactccttcgccacaagtttgctttcgataccaagctcctgtaaggaacagatcatgccatttgattcttcaccgcgaagcttggcttttttgattttgaaattgcccggcagcaccgctccgactgttgcaactgcgactttttgtcccttatccacattcggcgcgccgcaaatgatttgtacaggggcttcagctccgatatccacaaggcacttattcagcttatcagcattcgggtgctgctcgcgctccagcacatggccgatgacaacacctttgatgccttctcctttgtattcaattccttcaacctcaataccggctcttgtaattttttcagcaagaacagccgggtccatgccttttaaatcaacataatcctctaaccatttataagaaacaaacatccttgcatcctcctcttacgcctgtttaaactgcgaaataaatctgacatcgtttgtatagaagtggcggatatcatcaatgccgtatttcagcatcgcgatgcgctcaacacccattccgaatgcgaagccctgatattccttcggatcaaagccagccattttaagcacgttcgggtgaaccattccggcaccgaggatttcaatccagcctgttcctttacatactgagcagccgttcccaccacatttaaagcatgtcacatccacttctactgaaggctcagtaaacgggaagaagcttgggcggagtctgatttcgcggtcttgtccgaacatttttttcgcaacaagttcaagcgttccttttaaatcactcatgctgatgtttttgtcaacgacaagcccttcaatttgcataaattggtgagagtgcgtcgcatcatcgttatcacggcgatatactttacccgggcaaatgattttaacgggacctttgccttcatgcttttccatcgtccgtgtttggacaggggaagtttgcgttctcatcaaagtctcctctgtgatgtaaaagctgtcctgcatatcgcgcgcagggtgttctttcggaagattgagcgattcgaagttgtaataatccgtttcaacctctggcccttcctcgactgtgtagcccataccgataaataaatcttcaatttcttcaatgacaacagtgagcggatggcggccgccgactgcaacagggttccccggcagcgtgacgtcaattgtctgtcctgcaagcttctgtttcatttcctcttcttcaagcttctcgtttttgtcagcaatcgcattggcaatacgctcccttacttcgttcgcgagcgcccccatttttggacgttcctcagcagaaagcttgcccattccgcgcagcacttctgtaatcggccctttttttccgagatattgcacccgaatatcattgacaatcttcaatgagcttgccgcttctacttgttctaaagcttcttgttccagctgttttagcttttcttccattttgcatcctccttttatgtaaacaaaccgtcatatgtctttggaaaataaaaaaaacccgtcccttttacaagggacgagttgtggccgcggtaccacccttatttcagacagactgatgctgtcgtcagcttcattgacataacggaatcagattccggttcacctttacgcgcagtgtacgcggtcccggcgacaactcaagaggtgaagccaatttccggctgcgttaaaaatgctctcagtcagcggcattttctccctggaaagcagttgatcagaaattgaggtcctctgtcacggtttttgaaatattatgttctattatagagaaatccaacgcttggcgcaacactatcctcgcaagtgatacacgaggatggcagccgcaaccgcaacgtttagtgattcagcctgtccgtaaagcggcacgtacaggttcaaatccgttttttccagcaatgcagcatccacccctgcaccttcatttcctacaatgagcgcaaaggattcagactgaggaatctcctggtaaggcgctccgttttgcagcgccgtgccgtatacttttacgccctctgccttcaattcgtccacatatgaaggcaggtttcttctcacaacaggaatatggaagtgagatccttgagcagatcgcagtgtttttccgttaaaggcgtccgccgtgccgtcaccgagtacaaccgcatccaaaccggccgcatcagccgttcgaatcattgtgccaaggtttcccggatcttgaacagcgtcaatcagcagcaccttgcgtgccgttgccagcttttcttcaggcatatggcacacagcggcaatctgctgcggcgtttcggtttcagtcacagctgaaaacgcatcttcactcagcatatagcactggataccagtctcaagatctgaaggaatcttcgtttcatcctttacaaggatttctttcacaatgcccgggcttttcaacgcctcttcaacgaggtgttctccctctatcagaaatgtatttgtttttgttcgttctttttttgtgtgaagctttttccaatccttcactttttggttttttgccgattctatttgtttcactgtctatgtggcgctcctttttttaacatgatgttattatatcgcaagaacagcacataataaaccaggtgcagggttagaatatacgtattacattttagaaaaaggagcgttttacatggatcttaatttacgtcatgccgtcatctccaatgtcaccggcaataatcaggagcagcttgagcatacaatcgtagatgcgattcaaagcggtgaagaaaaaatgcttccagggctcggcgttttattcgaagtcatttggcagcacgcatccgaaagtgagaaaaacgaaatgctgaaaacgcttgaaggcggattaaaacccgccgaataagacatgaaaccgggtgacagcgcccggtttttttcttatataataaaaacatgatgagggggaacgccatgtttttacagccgttattagcgaaaaaaattattgctgaagtaaaaaaaatgtacgaacgtgaagtcattattgtaaacacggacggtcttattatggcaggcacaaacgatgaacgtgtcggacaatttcatgagggagcgcttatctgcgcaaaagaaagacgcagcgtgattattacaaaagaagatgaaacaagattaaaaggagtgaaagcaggcataaacctccctgtattttttgaccatgatgtgatcgccgtcttcgggctgacaggtgagcctgcagagattcagccattcggagaactgcttcgaaaaatgacagagctgttcattaaggaatcacggcatttagagcaatcccagtggcgtgagagaatgctggagtcctttatgatcgattggctgcaactaaaggagtggtctcccagttttcttgagaaagctcagcttcttggtgttaacctttcctcccggcgccaaatgattcttattcaggggtatgagtggtcacgtcatgatattgaacaaatggcacgcagctggaaatcctcgtaccctgcggatttgttcatcaggtggggaaatgaacggatcttgattaatcatgaagtgccgcagcatgaacaaagggatcggcttttacggaagatccttcacatttgttcgtttgccaataccgcaaacagccaatttgcagcagctggcgccggaagggctgtcgcaagctccagcctgacagattcatacgagcaagcggaaaaagcgctggctgtcagccttaagcgaaaaacgcccatatttgaagaggatctgaagcttgatatgtgtctgacggagatcagcccgggaacccgaaacgaatttccgcaaagagtattaggagaggcgctagagcatcaggaacttatgaatacgttacggactttctttcatcacgatttgtctttgaaacaaaccgcagaagatatgcatattcatatcaatacattgcgttatcgtctggctaaggctgaacagctgacgggtttacgttttgaccgtaccgaggacgtcgtcacgatgtacgtcgcactctattttttagatcaagatacaaaatagagagagtttcagtttcattttttgtatgtttctccatggaaggctttgctttttttcttttacaatagattgaaagcattttttgacagggggatgggtgaaatgatcaccaaggatgtaaaggaacagctgattcaggtctccggaccagaaaactttgatgactcgaatgccggccgtctcgtctattcatatgatgcgacgcctcagtatcagtctatgcctgatgccgtgattgctccgaggaatactgatgaagtatcacgcattttaacaatttgcagcgaacatcgagtgccgatcgttccaagaggatcagggacaaacctgtgcggcggcacgtgcccgactgaaggcggacttgtgcttctctttaagcacatgaaccagattcttgaaattgatgaagaaaatttaactgccacagttcagccgggcgtcattacgctggatatgatccgcgcggttgaaagcaaaggtttgttttatccgcctgacccgagttctatgaaaatatcaaccatgggcggaaacatcaatgaaaattccggcgggctccgcggattaaaatacggcgtcacccgcgactatgttattggactggaggttgtgctcgcaaatggtgacatcatccgcaccgggggaaaactcgcaaaggatgtggccggatacgatctcacacgtctttttgtcggctcagaaggaacactcggcattgtgaccgaagccatcgtcaaacttgttccaaagccggaaacaaagaagacgttgcttgctctttatgaaaacatcgatgccgctgctcaaacggtatcggacattattgccgcaaaaattatacccgccacgcttgaatttctcgaccagcctacacttttggtgattgaggattatgccaaaatcggacttccgacaagcgcaaaagcagttctgttaattgaacaagacgggccatttgaaactgttgaacgggatatggaaaagattgaggcgatctgcaaaaaaggcgacgccgtttccgttcagaccgcacaaacagaggaggaagcgtttgccctgactgaagcccggcgttctgcactttctgccctagcccgcctcaaaccgacgacgattttagaggatgcgaccgttcctcgctcagaaatcgccaatatggttaaagcgattaatgatattgctgctaaatatgatatttccatctgcacctttggtcatgcgggagacgggaaccttcacccgacatgcacgacagacataagaaataaggatgaaatggaacgtgtcgaacaggcttttgccgagatttttgagaaagcgattgaacttggcgggacgataaccggagagcacggagtcggggaaatgaaagcgccttacttggaaatgaagctgaaaaaagaaggcattgatgcgatgaaagcgttgaaagcggcatttgacccccggaacatattaaatcccggcaaaatgtttgcgaaagatgccagaaaacgtgtggtggcggaaagatgacaacagaaaaagaaatgaaacagatccaaaatgaatttaaagagcgtatggatgaaggagagttattaaattgtatgcgctgcggcttctgtcttccttcctgtccgacctatatcgaatcgggatttcaggaaacacactctccgcgtgggcgcatcgccttaatgaaagccgtagccgacggtatgattgaaccggatgaagatgtcgaacggtcgctgtcactttgcctcggctgccgcgcctgtgagcctgtatgcccgtctggcgtgaaatacgggcagctgcttgaggaagccagagatattatccaccaaaataaaaaacactctcttggtgaacgtgtcatgcgaaagacggcttttcacgagctgtttccgcatcaaaaccgcatgcgctcagctgtaagccttatcggtttgtatcagcgttcaggactgcaaaccgctgtgcgaaaatcaggcatgcttcggatcctgcctgagcatttgcggacgatggaagctgttcttcctgatgttccaaaaagcaaagacatgaaacatcggccgcgtttcctgccgtccattggccccatgaaaaaacgggtcgcctttttttcgggctgcttaatggatacgatgtttttaccgactaacaatgccacattgaagcttttacagctggcaggctgcgacattgtcatcccgcctgaacaggcttgctgcggggcgcttcatggacacagcggtgaaaaaaacacagggaaagagctcgcgaaacaaaatatcgctgctttcgaagcattagacgtggatgcagtcattacaaacgcaggaggatgcggagcctttctgaccgaatatgatcatttgctgaaggatgacccggaatggtcggagcgggccgccgcttttgttcaaaagctaaaggatttttcttccgttttggttgaacttgatttccatcaaatggacttagcgctcgagacgcctcaggtcgttacctaccaagattcatgccaccttagaaatgtaatgcatacgtcgcttgagccccgccagcttcttaaaagcatcaaaggggctgaattcaaagaaatggagaaagcagacagctgctgcgggtcagcgggaatttacaacatcgtcgaagctgaaatgtctatgagaatactggacagcaaaatggctgccgttaaagcaaccgaagcgattctcattgtaacagcaaatcccggctgcctgctgcagatgaagctcggcattgaacgcgaaggactaagcggtaaagtcagagccgttcacctggctgatttgctattggaagcagccgggcacaaaacatcatgagaaagcccaaaacagatattgttttgggcttttgtgcgttattccatcggactgcaaatttcgatataatgtccatccggatcagcgatataggcgaccgtctgcccccatggtttcactttcggctccccgataatcgatacgccttgttctctcatccttttgatgaccgcttctacattttcagtaacaaacccgatttcaaatgtgtttgaagcagatgtatccggaatgtccagcgccgtgatgtctctggcgctttcccgcgtattaagcgccaatatcgtagaccctgtttcaaattcgacatacgtgccgtgttcagcacgaatcggcagtcctaaaatatcccggtaaaaatgaatagcccgctggctgtccgatacgtatagaataagatatttcattgatagattcattgccaacccccctcagcatttttcaatagtccttctagcccggtatagatgcttccatccttaagctcggatctttccacatctgcgcccattttttcacagccgccacgataatgatgaagcctaacaccagcatgatgatagataatacgccattcaatacactatatcctgctgcttcaggattgagatacacattgcgcaccatccaatagcccgcataattgacagtgacatataaataggcaagcgggataaggcaagtcagaatgtaccggcgtttatcagcgattttcagcacgatcgtcgctccgataatcagccccactgaagccatcagctgattagaaacgccgaacagcgcccaaatggaaccgatatctcctgaatacagcaagtacccccacatcaaacaggcaagcgcgctggcaaatacagagcccggaatccagtctgttttcttcagcggtttatacacctccccgaagaaatcctggatcaaataacgggcaacgcgtgtgccggcgtcaatcgctgttaaaataaagaccgcttcaaacataatgacaaattggaaaaagtatgaggccaaatggctgaaaaacggcattccggtaaaaatataagtcatccccaccgcaagcgtgacggctccccctgttcttccttctaagtccaaaccgatttccccgctcaattcaggcaaatgtacgacattcatgccaagcgtacggaaaacctcaggcgtgctgttaatcgcaaagtaatcagcaggctgtaaagcggtcgctgcaatcagcgccatgatgccgacaagacactcaacaagcattgcgccaaacgcaaccggcttcatatcactccatttattcagcattttcggtgtcgttcctgagccgacaaaggcatggaacccagagatcgccccgcaggcgatggttattgagatgaacggccagacaggtcctgccagcaccggcccgccgccttttacgaattctgtaaacgcaggaaacggaatagacggattgacgacaaacacaccaacaatcaaagcgataaaaacaccgattttcataaagctgcttaaataatcacgcggtgcaagaagcagccaaacgggaagcgcagccgcaaaaaacgcataaacaggaagcgcgattgcaagcgttttcgtatctagcgttaaaaagtcaccgagcgcggtagtctgtacccatggaccaataaagactcctgccattaaaaagagaaagccgaccgttgaagcgagctttaaatttcccgttttcttataaaataagcccacacccatcgcaatcggaatcgtaatccctaccgcaaatgttccccatggattacgttcaagcgcatgcaagacaaccatcgacaggcccgccattgtgatcgtgatgataaacagcatggacagtcctgtacaaaatcctgcaacagggccaagctcatccttcgccacttccgacagcgattttccgtttttgcgcatcgatgcaaacaacaccacaatatcatggacggctcccccaattaccgccccgattaacagccacaataatcccggcaaatagccaaactgcgccgccagaattggtccgaccagcggcccggccgctgcgatcgcggcaaagtggtggccgaacgaaacccatttatttgtaggcacatagtctttcccatcctcaagcgcatgagcaggtgttggcttgtcatcattcactttgagaaccttcaccatcataaatgttccgtataaacgataggcaatagccaaaatacacattgatgctatcacaattgtaaccgcattcattttctcccatcccctttgctgtttttcataaatatatcacaatttcatggtgaaaagcggtcattttttcctatacaaaaagccggcttgaacgggccggctcgtggcagttgaaagacaagccggagatttctctccggctttgctattcttatgactgttttttcaggcggatcacattccaggaaagcggcgtgaaatgagcagttaagccgttttcgctgacagacgatgatccgttggaatgcggaacgacattttttctgttatgctggtttgtcgctttgatatcctgatgctcaagtacgatgtgctctgcgatttggtaagattcaaagcctctgagcgaaatctccgtctccatctgatcctcagccttgtttaccgcaaaaatagtgagggtttcttcctcttcagagtacacaacagcagcatcaacatatggcacatcagtgaaatcagaacaatcgtacttaggagaagaaataagcggtttcagtgactcgccccttccgtaaacagaagcatgcatgtatggatagaaaatcggctgtctccatgcttctccgcctttttccgtcatgatcggcgcgatgacattgacaagctgtgcaagacacgcaattttcacacggtctgcgtgctgcagcatcgtaatgagcagagagccgactaataaggcatcttcaaaattgtaaatatcctctaaaatcggacgcgcagtgatccacggctcgacttttttatcagcctcatttgagtggtaccatacgttccattcatccagagagagattgatagttttcttgctgcgtgtttttgcttttacatagtcacaggtcgcagcgactgatttgataaaatgatccaaatccatggaacgggccaagtagtttggcagattgttatcccggtttccgtagtaggtgtgaagagagatatagtcgacatgctcatacgtatgctccagcaccttcgcttcccaatcgataaaggtcggcatgccgctgtttgagctgccgcaggcaacgagttcaattgatggatcaacccatttcatgacctttgccgtctctgcggctagccgtccgtattcatcagctgttttgtggccgatctgccacggtccatccatttcgtttcctaagcaccatgttttaatgccgtacggctgttcatagccatgcgatcttcttaaatcactccagtaagagcctttcgggtggttgcagtattcaacgagattacgggcggcatctatgcctcttgtgccgaggttgacggccatattgacctcagtgttcacctttttggcccaagataaaaattcatttgttcccacttcattggtttctgtcgtttgccatgccaagtcaagccttctcgggcggttttcgactggtccgacaccgtcctcccagttgtatccggataaaaagtttccgcccggatagcggatgatgggaacctgtaattctttgatcagcgactgaacatcttttctaaacccatcttcatccgcttcagggtgatcaggctcgtatatgccttcatataccgcacgacccatatgttcgataaacgagccataaatccgtttatctacttcaccgattttatattctttgtctacaatcattcgcgcttttttcatcacacgtttcctccttcattaacctttgactccccctaccgtcaggccggagataaagtacttttggaaaaacaagaaaatgataatcaccggcaaaatcgcaaatactgagccggatataagcatgtcgtaattatttccataagggctcagcaagctggacagccctattggaagcgtaaacatttctttcgaccgaagcacaatcagcggccacaagaagttgttccagctgtttaaggactgaaggataatcatcgcaccgaaagccggtttcatcagcggtgccataatcctgaaaaagatgccgaattccgtacagccgtccatccttgcagagtccagcagatctcttggaaggccaagagcatattgcctaaaaaagaaaacggcaacaggtgaaacgataaacggcaatatgacacctgtatatgaatcgatcaagtgcagtccgacggtaagcttaaacagaggaagcatcatcacttccagcggaaccatcatgataatcagcacaagaacaaagatgatatttctgcccttaaaatcataaaccgcaagcccgtacccgatcatcgaagaaaaaaacagggtgagcacggttgtgaaaagcccaagtacaagactgttaaaaaaccatttgaaataaatgcttccgccgttaaacagaaatgtataattatcaagactcattactttaggatcaatgtcgagattgagccccacacgcaaaagctcagatgacggctttaatgatcctaaaagcaaacagaaaatcggaaaaagatacaataggctcagcatcataaaaaacagggttagtgcgattctgtaaacgctgaactgaggactgtgccgcaacatttatccctcccccttaaacgagcctgacagctttaatgaaatcaggctgacaacaaggatcacaatcaaaagcacgatgccgatggctgctccgtaccccatttcgttgtaggcaagcccctgctgatacaaatatccgacaagcgtcagaccaatattacccggggaattattctgccaaaggacgtagctttcctcaaacatcctgaagccgccgatgatgctgatggtcagcacatatacggttacaggcttgagaaacggcagcgtgatgtgcagaaattttttcattgtattcgcgccgtctatatcagcggcttcgtacagctctttcggcacattttgcaaaccggctaaaaagtaaaggatgttgattcccatccatctccatgaagcaagcagcaccatcaaaaacatgccggtatgttcattgttcatccagttctgaggtgaaaagccgagtttgagtaggatggaattggccagagacgtttccatttctccgaagatcagccgaaaaatgatccccgcgacaatggttgaggtcaatgccgggataaataatgctgatttaaatatatttctaaatttgaccagctttgaattcaggaatatggccagaagcaatggaacaggaatcagcacgatcagcgtccaaaaggtgtattccagcgtattccaaagggcggtatagaacgtcgggttgtttagcgctgtataattagacaatccgacaaaggacacctctcccggcaaaattctttggaagctcatgatgaagacactaatgatggggtatagaaaaaatacgagaaaggataaaacgaatggcgctgtaaacagatagggcgccgctttttttgaataaaacagatctcgccagcctgattgtttcgcagctgaaggaacgggatgaaccgttcctgttttcacaggtttcatgagaacctccccgctttcactttttgaatgggattctatttctgtttcagttcacctgccgctctgtccaaggcttgtttaggcgttttttgctgagatttaagtgcgtcgaacaacacgcttctgttgacaaggtctgaagccttggcaaaatcctcatgtaaataaatcggattgatttcatccttgatatcgagcagcacagaaaaaatgcctgttccgttttggaagtaatccgtgtatttgtttttctctttcaattccttggagctccaaacatcccagcgaagcgggtcaaagccgagtacgctccagagttttttatttccttcttcagagcccttcgcaaaggccaaaaactcttttgctaactcaacatgcttggattgcttcggcacaacggttgccgtaccgcccaagcctgccgagcggtcgcccccctctttccatgccgggagcggcctgatggcaatcttccctttcagatcaggcatataatcgataaatcttcccatataccaaatcggcatgaggactgaagcagctcctccttggttcataaagccgtagtattcttcactgtgatgcccgccgcccggcgcaggaatcatcgttttatcattgatcatgtcttttaaatattgaagtgtttttacgttggtgtcattattgaggatcagcttgccgtttttatcaaaatagcctgagttttgctgtgaaatcatagataagaacgttgcggaatcatttgtttccaccgttcccatcggcttcccggtcactttgcgcactttctgtccggctttatggtaatcatcccatgttttaatatcgtcaggattgacgccggcttttttcatcacatccatgttataaaacatgaccgttgttcctacatgcgtatcgagtccgtaaagcttgccgtttttgctgtacagggtcagccgcgcctcaacgaatttatcgcggtccttttcaatcagcggagtcaagtcggcaagcggtatgtcagagcccttcaaaaagtttgaaaaacgggccaattcgacatcggcaatatcagggacgccttctcctgcaattaaggagatagacaagttatcgtgcatttgtccatacggataaacgaccgtattcagcttaattttgcggtcaggatatttttcattccattccttcaccatttctacatagaactgctcatgaagtccgttaaatgtccaaaaggtcagctcggtttcacccgacttcccggatgatctttctgctgaacacccagcaatgactaatgtcaatgtcagcaacatcatgagcacaagaaaacagacagtcatttttttcatctgcgttaccccttccattcgaggtgcgggctattcatatagaccatggttgatcagcgttttgttttcattgatgattcttaatccggtgcagcggtctcttaaggtgtgcgcgtgtctgaaggcattcttgacggaatcctgcccgacaccgatttcgtcaaaatacgcagggcctccggctgatctcagccaatcagccagcacttctccttccgggagagtttgataagccgattggatggcttgccgccggctcggtgaaaattcgttcagcccgtcatccttagcgagctttctgtatgtgtcagttaataaaacagctgcacagcccacctttgccccatgaagaatctgtggccgttttttctccattaattccatctcaatccaatgtgaaatatgatgctcgccgcctgatgccggtcgggaatgatctaatgccagcatgacaagccccgatacaagtaaagactccatcaaaacccgtatgccagtttccgttttcatcgcaatgtcttctgtgtgttcaatgcaggcagcaagcgcctcctgaacaatcttagctcctgctggcgaataaggctcgccggcaagatgccgggatatttcccaatctgctaaagacgttattttaccgagcatgtcaccaaagccagctgccaccattgactgcggtgccgcttttaatagatccagatcagcgaacagtgcagatggggccttcgtttgaatggttgttttcgtgccatataaaataatcggcgcaccggctgatgtaaaaccgtctacagatggagcagtcggataagaaataaacggcaaatctctttgaaacgccgcaaagcggacgatatcatgaatcgtgcccgaaccgactgcgatcatgacatccgttggttgtttcgtatggatcagcacatgaatgagcgatcgttcatcagctgtcacatctccggcttcattttctggaatgatcaggcactcggcctgaaatccttcttgattcagctgattttccagatcaattcctgcaatgcggtgtgtattcgcatcgcagacaaggacaatatgtttattgtttttttgttttacgtaattcaaaagcgaatcagctgcttgtttaccgagaacaatttcttcaacttttataggcaacgtcttttctccggcgtgttcaaaagcacgctgaacgtcagctgcgatacgattcatatcagaatcccctcctcagccaatttggttacatccttaatagaatccagcacataatccggcgtgtacaaacgctgttcgccctgtttcgcagaaccagttagcactaaggcgcttttcatgccataaagcttccccatcgcaatgtcagattcaatgctgtctcctataatcatgcattcatgtgcggacagccccattgctgtacaggcagcctccgccatcagccatgacggttttccgacaacaagttcagtcttcgcttgtgcggaagcctctatcgccccaatcattccagccacatcaatggcatttccgtcttcgttcggaaaagagcggtctttgtttgtagcgataatacgagcgccgccggcagccgcttgaaaggcttgatttaaatcgtcgtacgtgagcgtttcatgaagggagatcacgagccaatccgcttccttcggttcgttcgcgttctgcacaccggccagcctcagctcgtcaaccaagccttgttccccaagcacccatacctttgaaaaacgataatgttttttcagaaaagccgctgtcacgcttgatgacagaacaatgtcgtttacgtccgtttcaatccccgcgccaagaagtttttttctgcacatggcacgggagatattcccccggttgcttaaaaagacgattttctttcccattctcctaagcgttttgatcgcttctcttgctccttcgatcaactcatttcctctgaatacagtaccgtccaagtcaatcagaatgccagccggtgacacaggcgtatcatgactggccataatacgcatttgctccgtgttttcgataaaaatgcttttcatgcaggactgtattgattggggttacatccttgttcagcataatggagtgataggccatttcggcaaccgtttctaatacaactgcgttatgaatggcatttaaggcgtcagtgccccagcagaacggtccgtgattattcacgagcacacccggcacctgttcgtagttatgatgctgaaaggtttccgctatgacttttcctgtattcagttcgtagtcatgaatgatttcttcatcgtacatttcacgagtacatggaatcgcactgtcaaaataatcagcatgggtcgtgcctaacggagggatgtctctgcccgattgtgcccagcttgtcgcccattgagaatgggtatggacaattcccccgatattcggaaaggctttatataaataaacatgggtaggtgtatctgaagaaggcttaagcgagccttcgacgacctctccatcaaggttcaaaacaaccaagtcatcggctgtcaggtcgctgtattcgactccgctaggtttgatgacaattctttctttttcacggtcaatgccgctgacatttccccacgtaaaggttaccagctgatgctcttgaagcttcaggttggcagccagcacttctttttttaatgtttcaagcatgctccatcaccctttatcaattctttttggcggcagatgaaaattgaagatttttgatcgttttcagacgtttcatgacatggttttcttttccgaaataatgaaccagctctttatattcagcgtacaatttttcataaaccgcggcgttttcggcatttggcgtataagttatatctttcagttttcccatgttcgccgctgcctctttgatgtcatcgtagccgcctttttctttgcctgctgcaagcgcgccgaaaatggcagatcctaaggctggtgcttgcggtgaaccagagattttaatgtccatgtttgtcacatccgcataaatctgcatgacaaacgggtttttctcagctattccgccggctgcgtatagttcctcaatcggaacaccgctttctttgaatgtttcgataatcattcgggttccgtaagctgtcgcttcaactaacgctctataaatctcttcaggcttcgtcagcagtgtcatgccaagcagcatccctgttaaatctgcatcaacaagagttgaacggtttccattccaccaatctaaagcaagcaagccgctttcaccaggcgcttgatggtttgctttctcactcagcagctcatgaacgccaatgtttttttcctttgcttcctcttgataagctggcgggacacatgttttcacaaaccagtcaaaatgatcgccgacacaggactgcccggcttcatatcccgcatagcccgggagaattccgttgtccacaacgccgcacattcctggaacgatatgcacctcttcaccaagtagaacatggcacgtcgaggttcccataatcatcagcattttccctggctctgtaatgccgaccgccggtacggaaacatgagcgtccacattggcaaccgcaacagccgttcccgggagaagtccggtcagctttgccattttttcagtcagactgccggctttttctcctactgaatgaatagaacctgacaatttgtcttttgtaatcgttttcattgaaggatttaatttctcaaagaaatcatctgacggataccccgctttttcactccacatcgctttataccctgcggtacaattgcttcgcttgagcgagccgcacagctggtacacgatccagtccgcagcctcgatgatccggtcagccgcttcataaatgtgaggcgcttcctcggcaatttgcatgacctttggaatcatccattctgatgaaatttttcctccgtaccgctgtaaaaaagcctctccttcttcttccgcgatttgattgagccgatcagcatgtttttgggccgcatgatgcttccagagcttcacatagctgtgcggctcctcttcatattcaggcagcatgcataacggctgcccgctgctgtcaataggaaggatcgtacatgccgtgaaatcaattccaatcccgataatgtctttcggttcaacgcccgtctgttcgagtaaagacggaatggttgtttccaagacttcgaggtaatcagcagggtgctgcagcgcccagtcgcgcggcagcttttgacccgtttttggaaggacggtatcaatgacagcatgcctgtattcttttacagcagccgcaagttcctcccctgtttggacatgaacgagcaccgctcttcctgataaagttccaaaatcaacccctattgtgtaagccatgtgacatccccctctacttttgaagccggtaaagcgcctcgttccattttaactcgtgtttcagtttatgaattgtcgtatcacgggaaatgagaacactttcgatccccgccatttccgcccaatcaagcatttgctccgctgtcagttcataagacaggcaggtatgatgtgcaccgccggctaaaatccatgcctccgctgctgttttcaatgacggctccggcttccagagaacacgggcaaccggtaaattcggcatgtctttttcaatttcctggccggtgacttcattcagcacaaggcggaaacgcccgccaatatcaacaatgctagcttgaatggcagaacccctgatgccgttaaatacaaaacgcgcagggtcctctttgccgccaatcgaaagcggatgaacctcgattttcggctgatccaaagcgacagtcggacacacttcaagcatgtgagagcccagaatcatttcatttcccggttcaaaatggtacgtgtaatcttccatgaaggaagttctttttcctttagccatgattttcatcatccgtacaagggccgctgtcttccaatctccttcaccggcaaacccatagcctttctccatcaggcgctgaacggcaagtcccggcagctgtttcattccgtgcagcacttcaaacgatgtcgtaaacgctgtgtatccgccttgctcaagaaaagcggttaagccaagttcaattttcgcctgttctttaatggacgctacctttgcttcgtcacgttttgtttcctcactgatcacatatagtctgtcatactcggcataaagcgtgtcaacctcgtcgtccgtaatgcggtccatcacttcaacgagatccccgatgccatatccgtcaacctgccagccaaattgaatatgcgctcccaccttgtctccgtccgttaccgcgacatgacgcatgttatctccaaatctggcaaccttaatatgtctgctttcatttaatgcagccgccgtatccatccactgggacatttcttttttcacttcttcatcatcccaatagccggcaatgacttttcggctaagccccattctcgagttgatgtaaccgtactctcgatcgccatgcgcggattggttgctgttcataaaatccatgtcaatcgtaccccacgggatatcgcgattatattgggtatgcaaatgcataagcggtttttgataagaggaaaggccttctatccacatttttgcaggggaaaatgtgtgcatccatgtaatgatgccagcacatgtctcactgtactccgcttctcttaacagccctctaatggtttccggtgaagtgacgacgggcttatgagtgattttatatctggaagaaatcccgctgagcccctcacaaatgcttttagcatgctgatctacgagttccagcgtctcttccccgtataggtgctggcttcctgtcacaaaccagaattcataatcctttgtctgaagcatgtaaactgcccctttctcataaaataaaacgctttcaaatacaaaagatacgtactaatgatagaaaataaacctataaataaatatttgtacgaacaattttattatagtaattgactattatactgtcaatcttttctttttaaaaaagccgggggcagagcccggctttttgattcaataggacggccagcccgagctccaattcaaatcattgatgagaagctttggaatgccgttgtcattggcatcataggcatggcgaacaagaatgtttccgttcacaatatcctggcctccaggtcctttccattggtcattgcccgaatccaaaatggtgcctccgccttcaagcatgctttttccgcttttatcaagataagggcctgtaatgtttttggatcttccgtaagcaattttgtacgtactgtttaccccgtcacagcatttatcaaatgaaaccattaaatagtaatagccattttgatacgtaagagtaggagcttctaaggcacccccattattcggtctagctgcaatcgaatagagcgagcctgtaggcttcatcgtactcttatcgagcttagtcagcttaatgccgctccaaaacgagccgaatgcaagccacggattgccatccttgtcgaatgtcagctccgggtcaatggcgttataattatttgagcttgtcgaacgaatcaccaagccctcgtccttccagctccccgaactgatgcttgttgaagatgccaggccaatggcagatgtattgcttccaaaagaagaaacggaataatatagccagtacttgccgttatagtattggatgtccggcgcccactggttttgaccataattcggcacataattggaccaccacgatagcggtgtagtgaaaatggatttttgtacggtccaatttttagcgtctgaagacttcaaaacccgcagtccccgttcttcagtaagccctgttccaagcgcataccatgagctcccctctttaatcatagtcgggtcatgaagcagctcattggatgcaccccaaaacgctgcctctgcgggagcagcagaagtgaatatcaaacctgcagccagagctgcactcgaaaagtgtaagaagcgtttccatgtttttttctttttcaattttgtttaacctcctttatattagaaagcgcttacaaattagattgtttatcctcccttcctgtcaaatcgagctgcgtatcgtatatcgtcatgttcaggaaattttcggtatcccctttattgtagtcactatgctgtaatttgtacagacaaaaaaatagaatccgcctaaataggcggattcttccgtatctttattggtacgtaatttcgtcaaccgtttttcggtctaacttcttaatgacttccgtaattaactttaccgcgttttcataatcatcacgatgcagcatggccgcgtgcgtatgaatgtagcgggttgcaatggtaatggacagcgcaggaacgccattcgccgtcaaatggatggcaccagaatcagttccgccgccggcaatggcatcaaattggtacggaatgccggcttcctccgcagtggctacaactgcatcgcgcaaacctttgtgagagaccatggatgcatcgtaaacgataatctgcgggcctttgcccattttgctctgcgcttctttctcggaaatgccaggcgtgtctcctgctatccctacatcaacaccaaacgcaatatcaggctgaatggtgtgtgcagccgttttcgctcccctcaggccgacttcctcctgcacggttccgacgccatacactatatttggatgatctgtgttttgtaagtttcttaacacatcaattgcaatcgcacagccaatgcggttgtcccacgcctttgcgagtaggaatttttcattgttcatgaccgtaaattcaaaatgcggaacgatcatatctcccgggagtacaccccactccaaggcttcttcccggcttgaagctccaatatcaataaacatgtcttttatttccactgatttttttcttgcttcaggagataaaatatgcggcggcttagagccgataaccccagtgatttctcctttaattgtgacaacggtgacgcgctgggcaagcataacctgagcccaccagccgccaacggtttgaaaacggataaagcctttatctgtgatttgtgtcaccataaagccgacttcatccaaatgtccggcgatcataattttcgggccgttttctgcaccagtttttttggcaattaaactgcccaggcgatctgttgtcacctcatcagcaaatggttctatgtatgatttcatcacttgccttacttctctttcattgcccggtatgccttttgcatctgttaaatctttcagcatggtcaatgtttcatctaattttgccatgttccaaaccctccttcatcagtcctgcattcttattatacaaaacatggcgctaaccatacgactatttcacttgaaaatcgggtatatgtttttacagctttcttttagaaaaagtgaaacctttttctatgcttttcgtattacatcagatcatcaccataagggaggtgccttcacacaatgtttgtcatggttctaaggattattttgcttgcactttttgcttattgtatttatgccgtggtcaaatatgtcgcgaatcctaagagaaggcttaagctggcccaatcaaaagaacatttttatattattgatgaacaaaacaatacccggaagaattttcagctgacgtataaaggcgtgctttttgagggagaaaagcatattccttccaaggaccatccgctgtttattcacacgatctttgtctggacagaatctcctgagaagctgaaacatttctctgcaaaagattttgagaacattgaagaaaaagtgctggaacgatatccaaattgtaagattgactgggaccagcccattaaactcgcaaaaaaagcagaagagcgttaaacgcttttctgctttttataaatcaaacgggctgtagtaaatagcgatgagaatcgcttcaattaccagaagaagcggtactccatacttaaaagaagcgtgtttcgttttatgtctgaaggtttgcatgccaagccagacaccgagcgctccaaatacgatggctatcagccacagccggtcttcagaaattctccacttgtgctgttgcgctttgcgtttgtcaatgcccatcacccaaaaaccgcacagattaatcaacaccaaataagctgcaataatcatgttgcctcatcctttatatagaaaaagccgctctgctggagagcggctctatatgattacttgtttaattgagctttagcagcatcagcaagctgattgaatgcagtaagatcgtttacagcaagatcagcaagcattttacggtttacttcgataccagaaagcttaagaccgtgcattaaacggctgtaagaaaggccgttcatgcgagcagctgcgttgatacgagtgatccaaagtttacggaaatcacgttttttctgacgacggtcacggaaagcatagtttccagatttcatgacctgctggttagctactttgtataatgtatgttttgaaccgaaataaccttttgctaatttaagaacctttttacgacgcttacgtgtaacagttccgccttttactcttggcattgaatttccctcctaattgttccttatccgattacttgatgttagcaagcatttgtttgatacgtttgaagtctcctgcgcttacaacagcactcttgcgaagcttacgcttttgcttttgagatttgttggcgaataagtgacttgtgtacgcgtgagaacgttttaacttcccagaacctgtctttttaaaacgtttagcagatccgcggtgagttttcatttttggcatgggatttcctccttattgcttttcgtttttcggtgcgagcattaagaacatgctgcggccgtccatttttggttttgtttcgactgtcgcaacctcagcacatgcttcggagaaacggtctaatacacgctgaccgatttctttatgagtgattgcgcgtcctttaaagcggatagaagctttcactttatcgcctttttcaaggaatttaatcgcattgcgcaatttcgtgttaaagtcatgctcatcgattgtcggacttaaccgaacttcttttaagttaatgattttttgattcttgcgtgcttctttttcctttttctgctgctcaaatcggaacttaccgtagtccatgattcggcagacaggcggttttgcattcgctgcaactaacacaaggtcaagatttgcgcggccggcgatttcaagtgcttcctgacgggacttgattccaagctggtcgccattttgtccgattaaacggacctcacgtgcacggataccctcattaaccaattgatctttgctaataatgagccacctccatagtttcttcgaattgattcacaactcattttgtatgcattttgcaggcaaacaaaaagtgtgggcattataaaacacccacactacgaacatctgtatcaataaaaatgtacggtcaacctgccaactacatgcatgtgtcaatcaggtgagaagcgggtgcttctgcttgtgatttatattcaattcaataactattctacacaataccggatctttagtcaaggacgacttatccggaacaacttttacattgtaacatgggttttctatgagcgcaagagagaaaaagaaaatctttcatcccccccagaatgcaaagaaccaacaattccccccttatttcgcaatttacaacaaaaccaccgacaggaagaaatgtaaaacaaagttaatctctgaccgatataagaagcagaagggagcctgacacatgaacaaactgatacagcttgctttatttttcacattgatattaaccggatgctcaaatagcagcacatcttccgaatcaaaagtcgaaactgttaagacaactgcagcatttcctcaaaaggggctggagaaagagctaaaaaaactaaaacccgtttcattggacatgaagttcgagagtccacttgctactgagttaggaaagcggaaggcaaaagaagaagctgaaaagcaaagacaaatcgccgccgagaaaaagcttgaaaaagagcgggaggcgaaacgaaagaaacagcacgaggaaaaagcggagagacagcgattagcagagcagcaggcggcagagaatcagcgattagcggaagcaaaaagacaagctgaacttgaaagacagcggcaggcagcaatccaaaaagagcagaaagcgaacgctgagaaaaagcggcaatcgcaggcacaacggcagcagactgaggcacccccatctaatagtcaagatccaccatcttcctcgagtcagacagataaaaccattcaacagccagcttcagagcttcctgatgacgatggttatggttatgaagaacgaaaaaagtggcatgacgatcaagtagaatggggcattaaacaagggtatatcgatcccgaagacgcaccataaaataaaaaaagccaaggcattcagccttggcttatccaccgatcagctgcacgaacacagggatgaccagaaccgttaccactcctactacgacaacagcaatacttgccatcgcagcttcaacttctcccatctcaatcccgaccgctacaccaagtgcatgtccggatgttccaagagccaatcctttagaaatcggatttttcactttaaacaccttcaagaacaatgctccgagcgcatatacgatgacagcgttaaagatgaccgcaaaggctgtgatgtcgctgatgcccccgatgccttttgataaaggaagcgcaattgccgttgtagccgcctgcggaagcatgcttttcattacggccgaatcgagatgaatgcctttagcgagcaaataaacaatcgtgacagagcagatagagccggcaataatggaggccatgatttgccaccagtactttttaagcttatctctttgtttgtacaaaggaattgcaaatgcgatcgttgccggttcaaggaaaaacttaatgatctctcccccgttattataatccgcgtaggaaaaaccgccgatttttaaaaatgcgatccccagcaccatggcaacaaacaaaggagtgaaaaggaagaagcctttcgttttcttaaataaaaaggtgccgatgccgaatgcagcaagtgatacgacaatcccaaaataaggactcattgtgctttccatgtgaagaacctcctgtttcccttaatggtgaacgagttcgttattgttctgcgggctttgcactgtttttgttttcatgtccgctgcggttttgcgttttccgctcagcgacagaatcagctgagaaaacaatcccgtagcccccagcaaaataatcgttgcgagcagaatgacaagaacaatttgcaggccgtattgctgcatcacaccgagcgaattcataacagatatacctgacggaacaaataaaaatccgatcagagaggtcaaagacgttccgagcgtctccacttgttccagtttaatgactttcaaacataataggagaaataataagaccaaccctacaaccgatgccgggataggtattgggacaatagcggcaatcatatttgaaaccagcataatgacggcaaaaataaatgcttgtgttaaaaacccgtacacttttttagcactcattttcttcacctctttctctttggtacccccattataaataagaattccctgttataaagcgcttacaagataacatgccgaatagcgggtctgagttgcagaatcaaatggctgaaatgcaaaaagccgcccatcaaatatggagcagctttttcaattccttcgcatatgtccggctgaccggtattttcgatccgtctttcatgatcaaattatacgttgaattaaaccatggctgaatttctttaatatattcggtattcacgacaaagctccgatggacgcggataaaatcagaatccggcagctttttctcaatcacaacgagtgtatcgctgaccgtataagaatgatcgaaggtttttacattgacatgaccatcttctgttccggcatagataatgtccttcgtatccacaatcacaatcgattcccccacagatagcgcgagcttgtgctggccggcatggctgttttgctctgtttctacaatatcccgattgacttttttatattttttcagcgtttgctgaattctttcttcatcgaatggcttggttaaataatcaagagcatccacctcaaacgctttgagtgcatactggtcatacgctgtcgcaaacacaacagcaggaggatgcttcattttcttcaatcgctttgcgatatcaaaaccgttttctccagataaatcaacgtctaaaaacagcaaatcaggtttttgatccatcatttggtcaaaagcggattcgatattttccgcttcattgatttccatttcctcattggtccgcttaagcaagtaagccagttcatctcttgccagcatctcatcatcaactattaacaccctgagcatgttcttctccctctttcatctgttgcattggcacttgaaaggaaacctctgtccctttatgaacctcactgctgatatgcagtgcagcctgctgtccgaataaaccgatcagccgctgatttaggttataaagcgctgtaccggttccctccttagacggaaacggtttctttcccagttccggcaagacgtccggcggaattccgcgtccgttatccgccaccttcatatagacggatgcattatcagataagacacagactgtaaccttgcatatgtcttgttttttcggaaacgcgtgccgaagcgcgttctcgacaagcacctgcaaaacaaacggagggatttcaatctgctccagtctgctgtcgatattaagctcaattttatatttcccgggaaaacgcgcctgttctaatgacaaataggcgttaagatggtttagctcctttgagagcggaatcagcagctgtctcgctccttgaaggtttgaacgaaaataaacactgagctgcaataggagcttacgggttttttcaacatctgtacggcatagcgcagaaatcgtgttgatcgcattaaataaaaaatgcggattcacctgtgcttgaagcgctttaatttcagcatccttgagaagtttgctttgcagctctgcttccccaagctcaagctgtgtcgaaaacagcatggccagcccctcggcaagttcctcctctacctgactcaggcctgccgggcttttaaagtacatttttaaggtgccgattgtattgccgttcgatgtcagcggcagaacaattgcagcgtgcaaagggcattcagcatgcgtgcattcaatctcttcctgcgaaatcgccttcataatatgccctgttttaatcacctttttggacagcccggtgatcaaacttttcgatgggatgtggtgatccattcccgcaccgacatgcgcaaggatcttttctttgtcagtgagagacaccgcatctgttcctgtcagcttatggataatagccgctacacttttacaggagttctcatttaatccttggcgaaaaaatggaagtgtctgatcagcaatcgtcagcactcgatgcgtttcgagagcccttgcctgttcttccttgcgaatgatcgcttgaataatagacagaaaaataaaactgcctgttccattgatgagtatcatcggaattccgatcatgctgacaagctcccaagcgtcactgaacggctttgccatcagcaaaataatgatcatttgcagtgactccatgccgattcccacaagagcggcgatgcgcggtgtcggcattcgatatcgcttcgtaaaatacctgccgatcaagcctgcaagaacacccgctaaaatagatgagacggcacagcttaaggccgtgctgccaccgagtgaaaaacgatgcaggcccgcaagtatgccgatcccagcccctacaaaaggacctccgagaaggcccccgatttccacgcccaaaatacgggtattcgcgatagagcccgatggatctatcgtaaacacccagtcattgtttacaatcatatttctttgaatttcgatgcctgtataattgctgatgatgctgaaaagagaaaaaatagaaattaaaatcgcttttcctttatagccgtcctgattctgaagagcttgtctgaaaagtttcgtatgggcgagaatgaaccctaatataacaataatccccactctctccagcatcataatcattaaatgaatcattcatgtcacctgttctttccgttttcattctagcatgttttcgttttacggctgactgtttttttaaaatcgtctgaaaacatatttcacaaggcttttatctattgtaaaataaaacatgagccttttggcagaaagatttgaatctgaagcagaggagaagatcatgaaagccgtattttttgatttagatgatacactactttgggacgaaaaaagcgtcagaacaacatttgcagaaacttgcttacaggcggagaaaaaatatggccttgcccctgaggaattcgaagcagctgttcgcgaagcggcgagagaattgtacatgtcatatgagacgtatccatatacagtgatgatcggcattaacccgtttgaaggactgtggtccaatttctcagagccaatcagtgaaggctttcaaaagctgaacaagattgtgccggagtacagaagaaatgcatggacaaacggactgaaagcgcttgggatcgatgatcctgcatatggcgaatacttgggagagttttttgcggcagagcgcagaaagcgcccgtttgtatatgatgaaacttttgctgtactcgatcaattaaaaggcaagtatgaattattgcttttgacaaatggcgatccgagtctgcaaaaggagaagcttgccggcgtacctgagctcgctccttacttcaatgaaatcgtcatctcgggcgcattcggcaagggcaagccggatgtttcaatttttgaacactgccttaagctgatgaatattgaaaaagacgatgccatcatggtcggcgataatttgaatactgatattttaggcgcttcaagagccggaatcaaaaccgtttggatcaaccggacggataagaaaaacgaaactgacgtaacgcctgattacatcatcagcagccttcatgatttgtttcctatattagagaaataaaaaagcatgatctcttcaacgagatcatgctttttattttattttttcgcttcagctactgcctttttcacaaactcatcaagtgaaatggtttcagagttctgctctccatacttacggacgtttaccgctccgttttctgcttcttggtcaccgaccaccagcatgtacgggattttttgcatttgcgcttcacggattttgtagccgattttttcatcgcggctgtcgacttcaacacgcaggccttcacgctgcaggcgttcctgcacttttttcgcgtagtctaaatgcacagccggagaaaccgggatgacttggaactgaaccggtgcaagccatgtcggcagcgcgcctttgtgttcttcgattaagaaggcaacaaagcgttccattgttgaaacgacacctctgtgaatgacaaccggacggtgctgcttgccgtcctcaccgatgtatgtcaggtcgaaacgttccggcaataagaaatcaagctgtaccgtagacagtgtttcttcttttccgatcgcagttttcacctgaacatcaagtttagggccgtagaatgccgcttcaccttctgcttcgtaatagtcgtggccgatttcgtccattgcctctttcagcatggattgcgctttgttccacatttcatcgtcatcaaaatatttctctgtatcttccggatcgcggtaagacagacggaatgtgtaatcacttaaaccgaagtcttcatatacatcctggattaaacggactgtacggataaactcatccttaatttgatccgggcgcacaaagatgtgtgcatcatttaacgtcatcccgcgtacgcgttgaagccctgacagcgcacctgacatttcatagcgatgcatcgttccaagctccgcaatacgaatcggaagctcgcggtaactgtgaatgtcttgtttgtaaatcatcatatggtgtggacagttcatcggacgcaatacaagtgtttcattgtccatttccatcggagggaacatgccttcctgataatggtcccaatgccctgatgtttcatacagctctttgctgccaagcacaggtgtgtatacgtgctcatagccgaggctgatttctttatcgacaatgtaacgctcgatgacgcggcggattgtcgcgccttttggcagccaaagcggcaggccttgtccgactttttgagagttcgcgaacagctttaattctttgccgagctttctgtggtcgcgttctttcgcttcttctagcatacgaagatgctcttcaagatcagcttttttgaagaaagctgtaccatatacgcgctgaagcatttggtttttgctgtcgccgcgccagtatgcgcctgcaaggcttaacagcttaaattctttgatttttccggttgaaggaacgtggacgccgcggcacaggtcaaagaattcgccttgctcatagatcgaaacggtttctccttcaggaatcgcatccaatagttcaagcttcaggtcgtcgccgatttccgcaaaacgggctttcgcttcttcacggctgacttcttttcgaacgatcggaaggttcgcattaacgatttttttcatttctttctcgattttcggcagatcctccggtgtaatcgcttcgtccatttctacatcgtagtaaaacccgttttcgataaccggaccgacgccgaatttaacatccttgtagatgcgtttaatcgcttgagccagcaagtgagccgtactgtggcgcataatttgaagaccttcttctgagccttctgtaatgatttccactgtaccgtcttcattgatcggcgttctcaaatcgatttcttttccgttcagttttccggctaatgattttttctttaatcccggactgatggatgccgcgatatcttctgttgttgttcctttcgcaaactccttgactgctccatcaggaaatgtgatttttaccatatctgacatctttgtcactcctttttttgcatataaaaaccccgccccctatgaaagggacgaggttgaataaacggaatcgtggttccacccttttttccgcaaagccaatacggcacctgcggctctaagctctgtaacgggagttcccgtcagccattactgttccttttcaagaggttcacagctgaagttcaaaggcggtaaagcgaatggtccttagctgggaagcttgcagccagggcttccctctctttgagctggtatcattccttcgtgtccttatcaatacgtgtgtctttcttaatctcctatgtattataaattgttcaatccaaaaaatcaacacgatcgcgtttccttttttaaaccgacagccttaaatagacaggctgccggccctcatccttccgagtgcttcaccggtatttctgcatctgtaaaagcatgcagcgggagcatttccactctctcttgaaatacgttttgaatggtccttgccatcatgtgctcgggctggtcggtataaagcacgacttcatcaggcgcaatggaaatcagcggcgcgagcaaatgagaatcaatatacataggatgatcccggacaaatcttctgtctatgtatttcattttttcccgttccggcacatagcgcagctcccataatgtaaaggaaccatcatggacaatatgcacttttttgattcgcggctgtttggcgtccacatagtctctgagtgtttgaataaagttttgatattcctgttccatcttatattcatcaatcgctgcttctgtaatatctctcagctgcttatagtatgatccaagtcggaaggtctgaaaggagcgaatgtaaaatactccttcctctaaacagatcgtttggagttcatccaaaattgattgtttccgtgaaagcttcagcggctcaaacggaagatcgtctgcttcaccttcaataatactgtgtgcgagctgaaggatttgctgctgttcatcctggtccgtgaaacaataagtttcctcaatcaatgacagcatatgctcgtcttctttgcattccaaaaaaaatttgaccagaatcggctccataaaacgctgaataggaaaagccggattcgctttttcaatcccgatttttcgtatgccttcacggacaatgatattgttccgatcgtccgaatgctgaatgagatgtaaaaaagcggctgcatcatggtcatcttcaaagattatttcaagcatgtttgtccccccttacggcatctgttacaagtatatgggggatgtttttaaaatagacgtaaaggtcattggcaaatcttaatttgattcttggaacaagttttgcattttctttctgaagatgaacggcaatgagataaacacgatatacaaagcgagcaccataaagaaagcgggcagattgccagccaaaaagctcgcacccagcacattaagcgcaatcgtcccagggatgattcccacagccgttgcggcaaaatacggcagcgctttgacattggaaaggcctgccgcatagctgacgaaatcaaaattgatcggcaggattctcaaaagaaagatatagaaaaatccgttatcctccatttgcttctgtatggcttcaagcctttcgtaatgcccgttctttttcgccgaaaacaaaccagccgcaaaaaacgaaacagctgaagcgcacatcgaaccgaataacgtataaagcgtgccgagaagcgggccaaacgcaagtccgccagctattgaaataacagacaccggaaataaaacaagtggcctgacgatggatatcccgataaacatcagaggtgcaaagactccgaacgacaatacccataccctgatttctttcggcgatacattcaaatacgttttatttccccaatagagtaaaccagcacctgcaagcactgccagccatttgacagccgtttttcgtttcataccctcagttccttcccctttgaaccacagcaattatggatgtcggcggttttctccgtcaaggcggatcggagcagccaaatataatatccgctccattaatcttgcagcttttacttcttctttttctcccctctgcgaatacgtaaaatgatgcttcagctcgtcaggtgagaaattagaagaaaagaacgttggcagctgctgggacattctgtgctgaagcaccgttccgatgacctcatcccttacccagcttgtcattgattctgctccgatgtcatcaagcattaatacgggtgtggtctttaccatattgagcttctcttccaatgtctggtcttgcagcgaattcttaagctctctcacaaattcaggcacataaacaatcatggaggaatactctttttccgccagctcattggcaattgcagcgagcataaacgtttttcctaccccaaatttcccgtataaatataatcctttcccttttcccgtctcattatagcttttcaggaagtctgtaacatgctgaaacatcgcgagtctgcttgggtcactgatatcaacttgctggaacgtcgctccaagaagatcctgctggatatacatgcttttcataagagactgttgtttcttctgctggtcgagcttccgtttgactggacattcgtaatactcgatatcaatagacctcccattgacaacaagcttcggatggtagccctccaacaaattgttgcagttttcatcttccgaacaataggagcaattcttgctttgttcgatatattcataaagcttatttaagctcttttcgatcattttttggtcaatcacttcttcgttttccttcaaaaatgcttgaacatcttgatctttcatgactttttccttcatttgttcaagacgtttttggaaatccggcctgccggttacgccctgcagggaacggccgattggttccatctattccttcaccccgcatctctgtctttaataggcagagtattttttcagtttttgcatttcttccatcatctttttcttctgttcttccaaatcctgcggatgcagcttctgctgtccggattctgaatcggacgctgtttccttttctgtcatccaatcaggaagcttttcttcacgaatcactttttggtttcgtttcgaagactttgtttttccctcagcccattcaagatactggcggttttcttctattgcgagcttcatcgcttccctgaccgttttcacctttttgcgtgcccaatgcgaagcgattttttggatatagtttttcgacagcttcatgtcggttttcagcatgacataataaattaacacatttgtgacgcctggctcgagcttctgttcgaacataatttcttctatgatcttcagatcagcttttgacggctctgttccgtcagcaatgtcctgcagaagcttcttcggggaaatcgcctccagcaatgcaatcagcttcccatccagagaatcctcttctgccggtttttcgccttcacgcagatgcaccggctgtgttttttccaccaaatcgggcagctgtccgtttctttcaatttgataccagtcgctcgccgcttttcttaatgcctccgtcgtaatgacgtcacgctcatcaattgcgctcatcacaacattttgcatttgcaaagggtcaattccgtacagataagaaagctttttgattgtgtcccgcacctgctgggtcatcgcttttctcggtatcatcgtctcagaaagtcccgctaaaaacaaatcaaaatcaaacacatcctccgttatggtgtaggacggagactgtccgacagaagtatactcggacccctcggcaagccttaccgtttcctccatatcggatgtgagcttccattcactcggctgcagcgattcaaacgcatgattaaacggacgcgtaatgtccttcgcatcttctgaaatggccgggtgcgtaaaaaattgttttaattgctgatatttcgtttttccgaccctattatacagaaaaacattcagcattccgtcttcaaaaaattcatttggtctgagcggcggaaggagttcatatataaagaggcgctcctgccgctcggattctttcatatatactttcagcaatccgatgccctcgagcttcccctgttcctgatggatcgtttttaagttggactgtgtcatcgccatcagctgtctatgtgtggactctccgccccacagacggttttgttcaagctctccccacaatgtcatataaagagagaatgcaacagggccgattaagggctggtacagttgtgtaataatttgtctgtcaatatcctgcagcatcgatctgcttttaaccacatacgggtctacaggcagtacatctttccaatagtcagccatacattctcaaaccttccgaatttgtttctacctttcattttacaccgtttcttatatctatcaaatgccaattttgcacatgagaaaagagctagaagaatcctcttagctcttttaacgctctttctttattaagtcttttaattcatcgataaagacgtttatatctttaaactgccgatagacggacgcgaaccgcacatatgcgacttcgtcaatcttagccagccggtccatgaccatttctccgacgagctcactcttcacctcggagcagccttgattgcgaagttctttttcaatatcaaagcacatgtcttcaagcgttttgagtgaaacaggccttttttcacatgcttttatgaggccgcgcagcattttttctctgctgaattcctcacgcacaccttcttttttcacaacgatgagcggggtttcctccactttctcaaaggtcgtaaaccggtagtggcaggattcgcactcgcgtcttcggcgaatcgactttccgtcatccacaggccgtgaatcaaggactcgtgttccgttatgctggcatgaaggacatttcaataaaatcagctcccaactatatcgttccctgcaatgtattttcggcagcctccgccttttaaaaatagatgtgacagcatctgtcgggagagccgttgttaaatttgtttctatagcattaggtggtttgtgaaaatctccttcttattttacaaaaaaaatgaaaaaagaaaaagctgacactctcgtttctttataaaaataaaaggagcataagctaaaaagcgcataatggctttctagcttcagctccctttgtgttcgcaatttactttatagtactttcgcttgcgcctgtttaatttgcacaggccccattcctcttggtatttcaatgttttctcttgtatcagcatgtaatgcctctgcaatgtaatcagcagcgacattaggatctaagtctccacaagtataaacatcaatgctcgcatatccgtgctcaggaaaactgtgaatcgttaagtgtgattcagaaataatcacaactccgcttacgccttgcggtgcaaatttgtgaaatgcaacctcgcgcacctcagcacctgattttagagcagcatttacaaacgttttttcaataaaatccatgtcattcagcttatcaaaatcgcatccccatagctcggagataacgtgacgccccattgtttccatagtcatggacccccttaacaagaattaaaaagtgaaattccaacaactgggtcggccatttaccacgggggaaagttagtccggagaggtcctaaccctttaagtaattccgaaacagtctcaagcaagaagttcacgaaaaatagtatactgtgtttaagtctaatttgcaaggtgcgttttttcagaaatatgctgttaagggttttttctttaaaatgtgtccatgaccttattttatacagcagacggatgtttcattcgtgccgctacatggcggattagatcaacaactctgcaggagtagccccattcgttgtcataccacgccagcacctttactttcctgtcttccattaccattgttgtaagcccgtcaatgaccgctgaatgcggattcgtattataatcagtcgaaacgagcggttcatctgagtaatcaagtacaccgtacatcgacgttttggcagcgcgtttaaatgcctcgtttacttcttcagccgtaacatccgttttcagatcaacaacgagatcaaccaatgagacgttcggaacagggacacgcaaggcgaggccgtgaagttttcctttcagatgcggcagcacaagcgaaagcgcctttgccgctcctgttgttgttggaatgatggattcaccgcaagcccgcgcccggcgcaaatctttgtgcgggttatcaatatttttttggtcattcgtatacgcatgaactgtagtcatcagaccgctctcaatgccaaactcttcatccagtacttttacaacaggcgcaaggcaatttgtcgtgcatgacgcatttgaaataatgacatggcgctcagcgtcgaattggtcctcatttacgcccatcacaatggtaacgtcttcattttttcccggagcggtcaaaatcactttttttgcacctgcttctatatggcccatcgctttatctttagcattaaacttccctgttgcttcgacgactatgtcaatatcatattcccgccaaggcagctgttttggatcacggctgtttaacaaaagcactttctttccatttacgatcaggctgtcttcaccagccacaacctctttgtcgtatctgccgtgaattgtgtcatactttattaaatgagccagcgtttctgcggaatagctggcgttaatggccactacttgaatttgatcgtctaacatcgcttttctaaaaaccattcttccgattcttccaaacccgttgatcgctacttttaccttcatgttggacaccccttatcaattatgccatcctaatttgttactatctaaaattagtataacacattaaaacaaattcgccagtacatattgataaaaatcaacgattataacgctaatttatgatgcatcttatgttttcttgcacagaatatcaggcgtaagaaccaaaaagcagccagcgctccgcactgactgccctcatgctttatgattcctgttttaacttatcattgagcacactttcttctagcacagaaaatgtatccccgtatactctgttaatatgattcgctccccaagcacacagcatatctaaaattccttctaagctgcggccgtattcgctgagctcatattccactttgggaggaacttgattatatacgattcggttaatgacaccgtccgcttccagctcgcgcagctgctgagtcagcattttttgcgtgatattgggcattaggcgttttaattcgcttgtacgtttttttccgtgcgtcagatggcataaaatgacgcatttccatttccctccaatcacttcaagagtcgcttcaacagaaatgttatattttttcttctccatacaatccattctcctcacaggcaccaaaaagtgactatagcacttcaaagtacgtacttttatttcttaacgatatgtttcataatcacatttgccggctgatttgaatctgctcttttttatttatatagcttactcggcagaatttcaatcatacaacacatcttacaaaggaggaacatcatgacttcagccaaaagcagtattcctgcactactggctttggccgtaagtgcattcgcaatagggacaactgaatttatcagtgtcggccttttgccgctcattgctgatgacctgcatattccagtcacgacagcaggattaaccgtttccctttatgcgctcggcgttacatttggggcacctatattaacttcattgacctcaagcatgtcgcgtaagacactattgctttggatcatgtttatttttattgccggtaatacgatggcagcaaccgcttcaagcatcgggattttactagcagcacgtgtgatatcggcattttcgcacggtgtgtttatgtcgatcggttcgacaatcgcagcggatattgtcccggaagataaaagggctagcgcgatttcaattatgtttactggcctcactgtggcaactgtaaccggagttccttttgggacatttatcggccagcagttcggctggcgtttcgcctttatggtcattatcgccgtcggaatcattgctttcattacaaatggtattcttgtaccgtccaaattacgaaaagggacgaaaacaacgatgcgggatcaattgaagcttgtgacaaacagccggttattgcttttatttgtcattacagcgcttggatacggaggaacattcgttgtgttcacgtatctgtctcccctgcttcaggaagtaacaggcttcaaagccgggactgttgcagtgattctgctcggatacggaatagctattgctatcggcaatatgattggcggaaagctgtcaaaccgaaatccgattgccgctttattctatatgtttatcgtacaagcaattgttctattcgtactgacatttacagccccgtatcaaacagcagggctcattaccattctctgtatgggattgctggcctttatgaacgtgcccggccttcaggtgtatgtcgtcatgctggctgagcgttttgtcccgagtgcagttgacgtcgcatccgcgatgaatatcgctgcctttaatgcaggaatcgcgcttgggtcataccttggcggtgtgatcaccgattcaatcggattgattcataccgcttggataggcggattaatggtggtcggtgcagtcattttaacaggctggagccgcttaatggaaaaacgagatcggcaggaagcctgacaattttaaaggaggaaatgaacatgacaacacatttacaagcaaaagcaacacttcataatggggtagaaatgccttggttcggcctcggcgtgttccaagtggaagaaggatctgaactggtaaacgcagttaaaactgccattgttcacgggtaccgcagtattgatactgcagctatctatggaaatgaagctggcgttggagaagggattcgggaaggcattgaagaagcaggcatttcaagagaggatctgtttatcacatcgaaagtatggaatgcggatttaggctacgaagaaacactcgccgcgtttgaaacaagcctatccaaactcggtctggattatttggatctatacctcatccactggcctgtagaaggaaagtataaagaagcttggagagcgcttgaaacgctgtataaagaaggccgtatcaaagcgattggcgtaagcaacttccaaattcaccatcttgaagatctgatgacggcagctgaaattaagcctatgattaaccaagtggaatttcacccgcgcctcacacaaaaagagttgataagatactgccaaaatcagggcatccagatggaggcttggtcacctttaatgcaggggcagctgctggatcaccctgtattggctgacatcgctcaaacatacaataaatctgtcgcacaaattattttgcgctgggatctgcagcatggcatcattacgattcctaaatcaacgaaggaacaccgcattaaagaaaatgcaagcgtatttgactttgaattaacgcaggatgacatgaaccgaatcgatgcactgaatgaaaacttgcgagtcggtcctgatccggacaactttgatttttaatggcaaaaaaacaccgttcaatatgaacggtgttttttgtattatgcccagctgttcatgatttcatcaagctgccttttggtctcttcaagcgtgccgctgttatcaatgacttgatctgctcttgctgttttttcctctaagggcatttgagagcggatacggctgactgcttcttcttccgtcagctgattgcgcttcatcagacgttccagttgaagctcttttgtcacactgaccacaataattttatcaaccaatgattccaatttgctttcgaacaatagcgggatatccaatacaacaaatgcctcccgatttgcaacggcttcatcacggcgattgagcatttcctgcctgactgcgggatgaacaattgcatttaaagcgagacgcttttgttcatttgtaaataccagcgctccaagcttttttctatctatatcgccatttgagagcagtatgtcttcaccgaattcgtcaatgatttgccggtaggccggcatccctttttctaccgcttgttttgcaatgatatctgcatctataactgttattcctttttcaatcagcatattggctaccgtgcttttgccgctagctattcctcccgttaaaccaatgactaaggtcaagagatccactcctttttacaatttccagagcccaatcgtgattaacagaagccccggcaaaaacgccattttatcgatccatttccacttagacagaaaatggccggcattggttccaattgatacaaacagcgagctcatgattgccacggcgatgctcatcacaatcggtgaaaaaccgagaatggctgcgcctatgcctgctccaaaggcatcaattgataaggcaaatcccaataagaccgcctcaattccattgatcacacccgatttgtcgatatccgcactcatgggttttctcaaaatatgaatcacaatccctaatgaccgaacctctaaattaagcagcgttttttcatgcaataggtattctttatcttttgccggtttgaagaattggtacagaacccacgcaccgattccaaccaatatcaaaccgccaagcttctccgtcacatatacaggaaaaaacttcgtgagaaagcttccgatcagcatggatataaacatgacagcaccggaacagcaggcgataaccaaaatcgctttaaacggtattttcatttttctcaatccgtacgtaaatccgactgaaaaactgtccaagctgacagccaacgccagcagcagtatagaaaccatttgcatatccgtttcttcctttctgttggtgctcttgtatcagatgtgaaatgcccgggattcatcacaatcatatatatgggaaagtgaaaaatccgtgtttcgaaaatggcatcctccattacagagttactgatatatgcaccgacagcttggacgatgaagcattatgctacttttttttctggcactttgcgcaaaaatgcgtgcctcttcctccaacgacaattttcgaaatcatcgttccgcaatttttgcatggctcgtctttttttccgtacacaaaatgctgcagctggaacattccgatttccccttgggagttgatatatgaacggactgtgcttccgcccgcatcaatcgcctcctgcagagtgtttttgatttcagcgtgaagggttttgattgttttatctgataattgatttgcttttatctcgggatgaacacccgctctgaaaagagcctcatccacataaatgtttcctagtccaactaccgttttttgatccagtagggcagttttgacagcgcggtttgttttcgcaagccgttcttttaaatacgcactcgtaaattcttctgcatccggctccggacctaactgagaaagcgggagctcgcccgcttcttctcccggtttaaataagtgcatggttccaaatttccgcacatccctgtaccggagctgggttccatccgtcatcgtgaatatgacatgcacgtgtttatcgtcaggctcctcggcttgatgaagaccgtattttccttccattcgaaggtgagaaaccataacataatgatctaaatgaaacagtaaaaactttccccgtcttccgatggactgtatcgtttctcctgctagttttcgcgcaaattcctccggttcggcaggccgtttgatgatattcggccatctgatctctaccgatttgattgtttttccctttacaagcccggtcagagtgcgccggaccgtctcaacttctggtaattccggcacatccatcacttcctatctctgtttatttcgcatcgtaccaagatgggcctgatgcaaagtccacctttaacggcacatctaatgcaagcgcatgctccatcacttcaggaacaagcttttcaagaatttcaatttcttcctttggcgcctcaaaaatcaattcatcgtgtacttgaagcagaagccttgctttcaactgtttttctttcagcttggcagccatgtcaatcatggcttttttgataatatcagcggcgcttccttgaatcggcgtattcatggccgtccgctctgcaaaacttcggatattaaagttccggctcgtcagctcagggatgtagcggcggcgatgcataagcgttgttacgtatcctttttgcttcgcttcctgtactgaatcttccatgtacgcttttacgccttggaagctttccagatagcggtcgataaatgctcccgcttccttccgggtaatgccgaggttctgtgacagaccgtaatcgctgatcccgtaaacaatgccaaagttgaccgctttcgcctggcgtctcatcgcagatgtcacttcatccttagcgacatggaacacatccattgccgttttcgtgtgaatatccatatcatttgtaaaagcttcgatcagattatcatcctttgaaatatgggcaagcacccgcagctcgatttgtgaataatcggctgcaaaaatgagccagtctttttcagacggcacaaaagcttggcgaattttccgcccttcctcaagcctgatcggaatgttttgcaggttcggatcagtcgagctgagacgaccagtttgcgttaaggcctggttaaatcgcgtgtgcactttatgcgaatccggtctcgtcacctttaaaagcccttcgatatatgttgattgaagcttgccaatttgtctgtactgtaaaatatagtcgacaatatcatgcttgtcagccagcttttcaagcacatcggcagacgtagaatagcctgttttcgttttctttacgacaggaaggccgatcttttcaaataagatgacgcctagctgtttcggagaattgatgttaaacggctctcccgcaatctcatggattttttcttcatattccttcagcttcgcacccagttcttcacccatccgttttaaacggtcaacatcgactttgacgccagttgattccatttcgccgagaataagcgcaagaggcatttccagctcttcaaacagttcaagctggtcgttgttttccagctcctgaacgagcttttcccgaaggctttgaatcgctaacgctttgcggccaaggtgctcagacagtacgtcttctgacggcactgctcgttttgctccttttccataaactgattcatcacttgaaacgatatgcaagccgtaatccttagccacactcgcaacgtcgtcatatgaattgcccgggttgatgatataagccgcaaggagcgtatcaaactcggctcctttcagctcaatgccctgccagcgcaaagcgacaacagcccgcttgctgtcgaagacccatttcttctgctcgtcattttccacccattctttaaacacctcagactcaacggcagtgtctttcggaatgaaataagctcccttttcatttacgatcgaaaatccgagaatcggctcttcatgataattatcgccaatctgttcaacgacaaatgcggatggagaaaccaatatatcgcttgtcacgtctgtgactgttttgacattaatgtcttccaacgattgatcctgttctgcttctgcactgtcttctccaagccgttcaagaagcgtgttgaagccaagatctttaaagatggcaatgacctgttcacgattaaagccttgatattccaggccggaaacagatacctcaatcggagcatccgtcataattgtcgcaagctccttgctcatcaatgcttgatccttaaactcctcaagcttttccttcaatttctttccgctcacctcgtcaatggactccagcagcttttcaacggaatcaaattgttttaaaagcttaatcgcagtcttttctccgacgccgggcacacccggaatattatctgaggaatcgcccatcagacccttcatgtcaatgatttgttcaggcgtaagcccgtatttctctttgacatgctccggtgtgtaaaattcaacatcggtaattccctttctcgtaatggcaactgtcgttttgtccgttgccagctgtgttaaatccttatctcctgagaaaaccttaacttcaaatccgtctttttcagccgatttggccagtgtgccgataatatcatccgcttcatattgttccagttcatagcggctgatctggtaggcatccagcagctcgcggataaacggcatttgttcggaaagctcaggcggggttttctgtctgccgcctttatattctttaaatgtgccgtgacgaaatgttgttttcccggcatcaaacgcaaccagcatgtgcgtcggtttttcatcctcaagcattttcatcaaaatcatcgcaaagccgtatacggcatttgtatgaacacctttatcattgcttaacagcggcaatgcaaaaaacgcccggtaagccagactgtttccgtctacaagcactaatttttttcgttccgtcattcaatttcctcctaagaagcctcaggcttccattcatctcttacatagtcattagctcctcttattttaacaaagttcaatttgaaaggaaaatacgtgaactataagagaagacacaaaaaaggacgggaacacaaataggttcccgccgtcaaaattggctccttggatgaaggggttctactacatcctaccagcataggtttaacagtgcatgaagatattgttaaacctttgtaaacattaggcggacttttcagcggcccgtttcagcgtcacggtaaagacagttccccgtccaggctcgcttgtgacatcaattttcccttcatgagcctctattaaatgcttgacaatcgcaaggcccagtccggttccgcccgaattcctgcttctgtctttatctacgcggtaaaagcgttcaaagatgcgcggaatttcttctttctgaattccgattccagaatcagcaacctcaatctgaatgtctttttctctgggctttacattgatagccacggagcccccctcaggcgtgtaggttaacgcattgtttacgagattaagaaatacctgtttcagcctgtacgggtcaccagatacatattgagggtctttcggggcattcagttgcaaggagatgcctttctcatccgccttatgcttcagaagcgtttcaatctcaccaagcattttggccggctcaaacgtttcgatactgagcgtgaaattttgctgctcgatttttgagagatcgagcaaatcctgaaccaaagactgaagcctttcgctttccttaagaataatagagagaaattcagaaagcgcctctttgtcttccatcgccccatccaataacgtctccgtaaacccttttatggacgtaatcggtgttttcagctcatgagaaacattggccacaaaatccttcctcatctgctctaatttctttgtttccgtcatgtcatggaaaacgagcacaattcctttccattcatcgtccggccccataatcggaacgccgtccacttcaaaataacgccgttctattttgatcggaagtcttaacagcttgcatttctttgtctccgtcataaaaatgtcttcgacaagctggatcacttcttcatgttcaaatgcatcgtgataaagacggcgcagcatatgattcggattgatatgaaactgcttggcgtaagatctgtttacgagattaataaagcctcttccgtcgatcataatcagcccggagccaatgttttcaatgactgtcagcagccgatcccgctgcatttcctgcgttcgcgtcatttccatcagatcaatggcaaggctgttcatcgcatgtcctagcttatcagaacgcctaatatagccgccgtacgtccgtgcatcgtagttgcccttagagagttctgtggctacatttgtcgctgactcaattgaccttttataacgtgaggtcatgctggaataaaaataaacaatgacgataaatgcggtacaaagactggccgtcagcatcccccacaattcgccttttaagccgtcgcttttttcagaggcggaaagcagcacatatcctgttttttccccttcgcttctaagtgaaagtccgtaataaagcttgttatctgttgttgacagaataccctcatggccagaaacaagcgcctgcaccttttgggaatcagccgctctcccgttagacccatacagcaccttgccgtctgtatcgataacggatgcgctcacatcaagcgcgccgcctgcatctttaatgattttctcatttgtttgattattcagattgccggcatcaagaagcgaagccaagtattttgcttctttttcaatgtgttcctctgctttcctttgatcagatgtttcaaaaagctgctgtaaaaacagcccgagaacacaaaacaccagaatcatacagacaacgaatacagaaaaaaggcgcacacggtatttattcattcatttttggctcctccagtttataccccaatcccctaatcgttttaatgtagatcggttttttggtattgttttcaattttgtcgcgaagatggctgatgtgcacatcaacaattctcgtatctccggcaaaatcataattccagactgcgctcagcagcagatctcttgtcagaactctgcctttatgtctgcctaaatagagcagcagttcgaattctttcggtgttagttcaagctgactttctttaaagtacgcttcataatgatcaggcaggattttcagatcgccgattacgatctggccttccatttcatcgttcttcatctcactagagggcgcagctatttccgaacgccttaaaatcgctttgactctcgcatttacttctcttggactgaacggcttggtcatataatcatcagcaccgagctcaagccctaatactttgtcgaattcctcatccttcgctgtcagcattaaaatgggaaacatcagtttttgctgtctcagctgcttgcatacttcgattccgtccaattttggaagcatcacatcaagcacaatcaaatcaggcttctctgtttccgcttttttgagtgcttcttccccatccgaggcggtaatgacatcatagcctgaccgttccaaattgtactgtaaaagagtaacaatagattcttcatcatccacaactaaaattttcttgttcatgctgtgcctccagtattataattccccgacatcctatttctctattttatgtcatcttaacatgtttcatgattttattttagcgaaagcaggacattccgacaattcgccttttacatcatttttaaaagaaataaagacgtttatgataacgctttcatttatagtaaaaagagaaaggctgtattaagcaagcctttctctctttttattaggataatactttcatgacatttttgacagattcaactgatttattcagctgcgctctttcatagtctgtcagttcaagttcaatgatttgctcaagaccgttgccgcctacaattgtaggaacaccaaggtagatgccttcatagccgtattccccttcaagataagcaattgtaggaaggacgcggcgctgatccttcaagatcgcttcgaccatttctgtcagagaagccgcaggcgcataatacgcgcttccgtttccaagaagattcacgatttcgcctccgccttttctagtgcgctccacaattgcgtcaatccgttctttcggaataagagtttcaagcgggataccgccagcataagaataacgcacaagcggcaccatatcgtcaccgtgtccgccgagtacgaaaccagtcacatctttcactgacaggtttaattcctctgccacaaatgttctgaatcttgccgtatcaagcacaccggactggccgattacacgctctttagggaagcctgattctttgtacaccgcgtatgtcattgcatcaacaggatttgtcagcaccacaataatagagtcaggagaatatttcacgatttcccgcgtaacgcttctcataatcttttcgtttgtagagaccagatcatctctgctcataccaggttttcttgcgataccggctgtaatgacaacaatgtcagagccggctgtatcctcgtaattggatgttcccgtaatttttgcgtcaaagccttgaaccgggcttgcttcaagcatatcaagcgcttttccctttgtcgggttctccaattgcggaatgtcaacaagaacaacgtctgccagctctttttgagcgattaaaaatgcagttgtagctccggtaaaacctgctccgataacagaaacttttttacgagtatttcccatgtctctcttctcctttatggctagttttaggctttttccttgcttagtccatgtttttgatcagttcttctccgaactctgaacatttcacttcagtcgcgccatccattaatctagcaaaatcgtaagttacgactttggaagcgattgttttttccatagatttgataaccaaatcagccgcttcgttccatcctaaatgctcaagaagcagaacgcctgaaagaataactgaagatgggtttactttatcaaggcctgcatatttaggagccgttccgtgcgtcgcctcgaaaatcgcatgtcctgtttcgtagttgatgttcgctccaggagcaatgccgattccgccgacttgcgcagcaagagcatcagaaatgtaatctccgttcaagttcattgtcgcaacgacatcaaactcgtttggacgcgttaagatctgctgaaggaaaatgtcagcaatgctgtctttgataatgatttttcctgctgcttccgcttcgctttgcgctttgttggcagcgtcttttccttcttcttcagcaatgcggtcatattgagcccatgtgaagactttatctccgtattctttttcagcaagttcatagccccagtttttgaaggcgccttctgtgaacttcatgatgtttcctttgtgaacaagtgttacagatttgcggccatgctcgatcgcataatcaatggcagctctgaccaagcggcttgttccttcttctgaaacaggcttaatgccgatacctgatgtctcagggaaacggattttattgacgtttaactcattttgaaggaagctgataagcttttgcacttcttcagagccttttgcatactcgatgcctgcgtaaatatcttctgtattttcacggaagatgaccatatcagtatcttcagggcgttttaccggtgacggcactccagtaaagtatcttacaggtcttaagcagacgaataggtcaagctcttgtctgagcgctacgttcaaagaacggataccgccgccgacaggtgtcgttaacgggcctttaatcgcgatgaaatattcgcggatcacatctaatgtttcagcagggagccactcacctgttttattataagccttttctccggcgtaaacttctttccatgtaattttcttttcgcctttgtatgctttttctactgctgcttccaaaaccttcgaagccgcgttccaaatatcaggaccggttccgtctccttcgataaatgggataatcgggttgtttggtacgtttaatactccgttagagactgtaattttttcaccttgtgccacaataaaaacctcccagtatgtaattcatatttagaaaacattttatttttcttatatagaaaataaaatgatttttcctaacattcaatttaaagtgtaacccaattttgatgttctgaacaagaggctaacctcattgacgcaagccagcctccaatggttctttaggctctttcttcaatcggaacgaatttttgtttgtcagggcctgtgtaatctgcccgcgggcggatcagacggttgttgtcatactgctcaagaatatgagcgagccagccggacattctgcttacagcaaaaatcggtgtaaacaaatcatggtcaataccgaggctgtgatatacagaagccgaatagaaatcaacgttaggcggaagctttttctctgatgtgacgatgtcttctatacgaatcgacatctcataccatttgctttcgcctgtcaggttggtcaggcgcttgctcatttctttcagatgcttcgcgcgcggatcaccatgcttatacacacggtggccgaatcccatgattttttctttcttttcaagtttagcgcggatgtacggctcagcgttttccacttcaccgatttctgtcagcattttcataacgccttcattcgctccgccgtgaagaggccctttcagcgcgccgattgctgcagtaatgcctgaatagatgtcagaaagtgttgcgacgcagaccctcgctgtgaacgttgacgcgttcagctcatggtcagcatgtaaaatcaatgctttgttgaaggcttcaacttcaattggtgaaggctcttcaccgtttaatgtgtaaagaaaattctccgcaataccgtaatcttctctcggttcaacaggctcaagacccttgcgaattctggaaaacgctgcaaccaggccaggcacctttgcctgaaggcggatcgcctttctgtagttggcttccgggttcatggtatcagcctcgctgtcaagcaggcctagtaatgaaattgctgtccgaagagcagccatgggatgaacattttcgagggaataagatttgaagtgctcaataatttcttgcggaacggcagcttcctttgcaagctgctgctttaactcttcaagctcttttttgtttggcagccttagatgccaaagcaagtagatgatttcttcaaaacttgcattctctgtcaaatcatcgatatcataccccacatatgtaagggtatcatcaataatagaactaacagatgatgttgttgctacaaccccttcaagaccgcgtgtcgctgtcatatataacatctccttttcaataaatttcccctttaagagtgttgtaaaaacatgaggcttacttaaaaagcacgatgcaagtatttctctcccccaaaaagaaaatgcttacattttactggctgctggaactaaaaccctttgcttatgaaagaacataacaaattcttataagcttatttaagtttaagcctattctcattataaacaataatcagacatttgttaaatgtttacctataattttttttttcattctgtgatttccccgaaaaaacgcctttatttgcgggtttttgcataaaaaaaaagcggctttaaggccgcttttttttatgaagtgaacagttttacgatctgcatggctaaataagcaatccccgctccgatcagcggccccaccgcaactcctccaaaaagcgcgactgcaagaatggtcccgatcacgagagcagttgtaatatgcggatcattttcaagcagggccaggccgttttttgcaatcagcgccactgcgatccccgctccaagggcgatccatgcgtaggaagaccgcattgcttctccaagctgcttaaatccgatttctcccgtggcaatcgggacaagaacggcgatggtaataatggtcacaccccagttaatgccttttgactggatggtcggaaataatttctgatcaagcccaacgattttgatgatcaaaaggacggatacagcaaagagcaatgattggttttttgcgataagtgcgatagccaagagtaaaattaaaaataaattcgcttgtgtaaacacatgccatccctcctttaagatgaatgtattcatattcagccgcagcgtgaatacatataaaaaataggacatgctgacgagaggaggaccgttttcgtgaatcaatcttatatcactatttttttcagaaccctctttgtcatatcaatgaccgcagggtcgatagctgcggcctattattcgtttccgttaacttatccgttcctgatcgcccttattctttcttcagtgattcatcctgttgtcgattatttggacaaagtgacaggattcccccgaacgataaatgttctgggcgttcttgctttttttctgctcgcagccttcggcgtcctcaccattctggtagccgaaatcgtaacgggaacagcctatctagcaaaaacgctgcctccgcatatcagcacgtttatttcatattgcgaaaaattgtttaccactcatattcagccgctctataacgagttaactcttttgtttcaagaattggaaacgaaccagcaggcttccatcgtcactcatatccagacactcggtgattctgccgctaaaaatgccgggctcctgctgtcccacattctagagatgatcccgagatttttcgctcttcttcccaatacggcggcggttctgattttttctcttctggcaaccttttttatgacaaaggattggcataagctgaaagccatgcttgttttaattctgccggatcgtgtgacagctaacagcaaagcaatcagcagcgaattaaaaaaagcaatgactggttttatcaaagcacaagccgtcctcgttttcatcacgatggtgattgtatttatcggcctttctctcttaaaggttgaacacgccgcaacaattgcttttttaatcgggcttgtagatcttctcccttacttaggtgccggctccgtatttgtgccctggattttgtatttatcgattacgggccagctgccccaagcaatcggaattggtatcctgtacctcgtcgttcttattcagcggcagctgacagagcccaagatactaagtaaatctatcgggatcgatccgctggcaacactcatcgccctgtttgccggctttaaattattcgggtttttaggactgattgcgggaccggctgtactcgtcatcatccaagctttcatcacaacaggcgcattaaaagaaatatggtcctatatcaccgttcagcaaaaataaaacggcagccgttttttcatggctgccgttttttatttgatgatgatccgcttattcttcgacattcctctcagccatttgaacagaatcggcttacaccagccgcgggtaaacgggataagaagacaggcgccggccaaatctgataaaaagcccggaagcatcagcaatagaccgccaatgaaaatgcacagaccgtcagcaatcgcttctcccggcattttgccatattgaagatcacgctgaaccttataatacacttcggttccttgtttttttgcagctgctgcgccgataatgccagtcagaatcatgaatagaactgtcggcaaaataccaatcagctttcctaaaaataggaatataccgatttctattgccggaaacacaataaaaagcaaaaacaaaaatctcatatccaagccccccacacgtgtaacacgttctgttcaacaaaaggcatgataaagagaaaaggaagggattccccttccattttcacctgtaattaaagaacgctcgcacggccttgatagactgcgcctctggaagcgtcaactgtaatatcctggccatctgtcaaaatagatgtcgcattttccagacccacgataaccgggatgccaaggcttaatccgactaccgcagcatggctagtcaaaccgccttcttctgtaataagagcagacgctttttcaagggatgcaatcatatcacggtcagtgcttttggtaacaagtaccgcaccgtcagtcattttttgctcagcttcttttgcattttgtgcaacgacaaccggaccgtaagctgatttgcgtccaatgccttggcctttagcgatgatatcgccgacagtatgaaccttcattaagttcgtagtgccggactcaccgacagtgccagctgtaataacgataagatcgccgtgttttacaattccgctgttcaatgatttttggacagcatcctcaagcatctcatctgttgagctcgcattttggccgctttccgcgaatacgccagatacgagggcaagctttctggaaatagagtcatttacagtaaccgcaacaatcggagcctgcggacggtattttgcaatcatacgtgctgtatggccgctttctgtcggcgttacgatcgcagcagcattcaggttaatcgcagtatgtgcgacagattgtccaattgcgtctgtaattgtcatgcccacttggtctctgcgttttgagagaatttctttataatttaatgcttcttcagaacgggacgcgatgttatgcattgtttgaactgcttcaaccgggtaacttccggcagcagtttcaccagaaagcatgatcgcatctgttccgtcgaagatcgcgtttgcaacgtcacttgcttccgcacgagtcggacgcgggttgcgctgcatgctgtcaagcatttgtgtcgctgtaataacaggtttgcccagcgcgttgcattttttgatcagttctttttgcacaagcggcacttcttcagctggaatttccacacctaagtctccgcgcgcaaccattaagccgtcagacacttcgagaatcgcatcgatgttgtcaacgccctcttggttttcgattttagggatgatttgaatatcctgagcgttgtgctcttcaagaagctcacggatttcgagcacatccgtagaacgtcgaatgaaagatggtgcgatgaagtctactccttgctcaataccgaaaacgatgtctcgcgcatccttttcagtaatacccggaagattgacacttacgcccggtacgttaacaccttttttatttttgagtgttccgttgtttaatacttttgttttgatttcgcgtttagcggcatctacatcaagtacctcaagaccgataaggccgtcatctaacagaatcgttgaaccttgttcaacgtcatggactaaaccttcatatgtcactgaaattttatctgttgttcctacaacctcgtccattgaaataatgagctctttgcctgtttcaagctcaataccgccgttttccattgtatgtgtgcggatttcaggaccttttgtatcaagcagaattccaacgttcttgccaagttttttacttgcttcgcggatatttttaattcttgcaccgtgctcctcaaaatctccgtgagaaaagtttaatcgagccacgttcattcctgactccattaatttcgtaagcatttcaatactttcacttgccggaccgatggtacaaacaattttagtttttctcatttggttcacttccttctgaaatcttcagccttcatctgcacattagatagacagttcttttgaaagctgatacatgttttgctcaactgtgtgttttgtctcaagtatttctataatatcatggtctacaagcttattgttttgtatacctacacagcgtccgccttttccttcaagcagcagttcaactgcatatgcgccgagacggcttgccaacacacggtcagcagcactcggagaacctccgcgctggatatggcccaatacagataccctagtttcaagatttgtttcttcttcaatgcgtttcccgaattcaacaccgctgcctacaccttcggcaacaataataatactgtgcttcttgccgcgttcgtggccgcgttttaagcgggcaatgatttcgtgcatgtcatagtctgcctcagggattaagatcgattccgcgccccctgcaagaccggcccacaatgcgatatcgccggcatgacggcccattacttcgattacatatgtacgttcatgagaagtcgctgtatcgcgaatcttatcaattgcgtcaattactgtatttaaagctgtatcgaaaccgattgtaaaatcagtgcccggaatgtcattatcaattgtacccggtacacctacacatggaaacccgtgttccgttaattttttcgcacccatataggaaccgtctccgccgataacaacaaggccttcaataccaagcttcttcaagtttgctatccctttttcacggccttcaactgttttgaattcaggacatctcgccgtataaagcttagtccctccacgatgtataatatcgcctactgatccgagttcaagcttttcaatctttccgctgatcaatcccgcgtatccgttgtaaataccgtaaacttcaacgtcatgatagatcgcttttctgactactgcgcgaactgctgcgttcattcccggggaatccccgccgctcgttaatacccctatacgtttcattctccattcacctcagcaacatatatgattaaacataacatgatcattgccctaaaaacaatgaaaagggatctccatcctccctatgaaaccttacctattatacaattaaataaattgtttttaaataaaatttaaggaatgtcacaaaaaataaacgtgagccaaaggcttcacgtttatttagtttaccccgatatattgatcttcaaccgagactttgccaattgctttatatttttcatagcgctgctgaactaattcttcttcgctcagcttcagcaaagtttttaacgattgtttaagggtttcgtccatatagcttgcctgcagcttcacatcatggtgcgctccgccttttacttctttaatcatatgatctataatacctaattcttttaaatccggcgcagtgattttcattgtttctgctgcttttttagcaagactggagtccttccataaaagtgccgcggcaccttccggagaaataacagaataagtagagttttccagcatatgcaaatgattgcctacacccagaccaagggctccgccgcttccgccttcaccgatgacgatacagataacaggcactcgaaggccggccatctcaaacaggtttttggcaatagcttcactttgtcctctttcttcagctgctcgtccagggtatgcccccttcgtatcaataaaacagataattggtctgttaaatttgtcagcctgtttcatcagacgaagcgcttttctgtagccttcaggatgcggcatcccaaaattgcggactaggttttccttcgtgtctttgccgcgctgatgcccgattaccgttacagggaggccgtggaacttcgcaatcccgccgacaatggcttcatcgtccccgtacgctctgtctccgtgacattcaaaaaagtcggtaaacaggtgttcgatataatcaagagttgtcggacggtccgccagacgcgcgatttgaacccggtcccatggcttcagatttttgtaaatatcatcctgaagcttagcgagacggtcttcgagccgttcgatttccgcacttagatccatatcggaatcttgggtgaatttttttagttcggcgattttggtttgcagttcaatcaccggtttttcaaattctaatcttggagccactcaatgtcacctcctgtttgatgcatatccagcagattttctaacgtttttttcatatcgtcacgatgaataaccgcatcaagctgtccatgttttaataaaaattcagccgtttggaagtcctcaggcagtttttctcctattgtctgttcaataatccgtcttccggcaaaaccgatcagcgcgccaggctcagcgaaattgtaatcgccaagggatgcaaagcttgctgatacgcccccggtagtcggatgcgtcattactgaaataataagaccctgttcttcactgaacagttttaacgcagagcttgtcttagccatctgcatcaaacttaatacgccttcctgcattctagcgccgcctgaagccgtaaaaataataaacggaactttatcagcttttgctttttcaatcgcaagcgtgattttttcaccgacgactgaacccatgctgcccattctgaatgaagagtccatgacggcgactacagccgggtgtccgccgatggtgcccttgcctgtcacaacagcctcgtttaaggatgttttctcgcgatctttttcaagcttttccagatatcccgggaaaccaagcggattttccgagagcattccctgattgaattcctcaaaggatttttcatccatcaagctttcgatacgctgttttgcgttcattgggaaatgataatcgcagttcatgcatacccgcatatttttatccaactctttagtgagcatgatttttttacacttaggacattttgtcataatgccttccggaacatcgtgcttcgcttgatcagatggtacggaagcatactttttctttttcgtgaatatatcctttaacaaatgattacctcccttttgtgaagggttctcttcaccgcatgtcatcaaacagatagacttgctaataactttaccgaaactattgtactttttttgtcaaacgctgtcatcctcaattcgacaactttttattcgatgacgtgctcggaaaggcttgtatgaaatcagataaggtgttgaaacgacaaggttgacagcgcattcaaaaataatgttaaacccggctgaaatttttttaaggctaaccccctaaaaaaatttcagccgtcagtttaacttgagaacagcgcgccggtctccgccaacgcgctgccatttttggaatgaattaaaattattcaccaataatcgtaagttttcttgttttttctgcgacttcctcagggtcaacagtgattcttgcaacacctgtttccatcgcagcttttgccacagccttcgcaacagcaggcgcaacacgtttatcaaacggtgcagggatgacataatctgcgctaagctcatcttctgaaaccagtgaagcaatggcttcaaccgctgcgattttcatttcctcgttaatatgagtggcacgcacatcaagtgctccgcggaaaataccagggaatgcaagaacattgtttacttggttcgggaagtcagaacggccagttccgataacgcttgctccggcttcacgcgcatcttccggcatgatttccggatttggatttgccattgcaaagataatcggatcttttgccatgctttgaaccatttcttttgttaacgcgcctgctacagagacaccgataaatacgtcagcatcaacgatgacatctttcagagaaccgtctttgcgatcttggttcgtgaacttcgccacttcatttttgacatcgttcatgccgttcgggcgcccttcataaatggcccctttggaatcgcacatcacaatgtcgcgaacgccataatgatgaagaagcttgataatcgcaatgccagccgcacccgcgccgtttgcgacaactttaatggatgacatggattttccagacagtttcagcgcgttcacaagacctgctacggttacaatggcagtaccgtgctgatcatcatggaaaaccgggatgtttgtttcttttttgaggcgctcttcaatgataaagcagtttggcgctgcaatatcttcaaggttgacgccgccaaatgtcggttccagcaattttacagtttcaacgattttatcaacatcgtttgtgtttaaagcaatcgggaacgcatctacgcccgcaaagcttttgaaaagaactgctttcccttccataacaggaagcgccgcttcagggccgatgtttccaaggccaagcacagctgtaccgtcagttacaactgctaccatgttccccttcattgtataatcatatactttgttaatgtcttcatgaatatccttacacggttctgcaacacccggagaatacgcgaggcttaaatctttcgcatttctgacctctacttttgatttagactccagtttcccctggttgactttatgcaggtgtaatgcttcttctcttaatgacattctcctaaacactccttatggatattttttgattcgtatactgctgcgttgattgctgcattctgcggagtaaatctatctgaatatttaaacaggatcacataattgctccaattgtataacaaaaagcgaatcgttaccactgttttaaaacgacgtttttttgacccaacagctcttttaagcgatataacacctggtgatctgcattgatatggaacgactcaggtagcttaatcgtctgtttttgcctttcataatagagataaacgcctgtttcccctttatgctccagcaaaatgcgcttaatctttgccaggatctcctggctgtgctgactgctttctatttttatataaaccgatggcgctttttctgcatccatatcttctaataattctgcccgggacatgatgaattggatcttatcttgtctaacttcacatttccccgcagtgaacaaaagagcgccttctcttaaaacgggagaaagctgtctgaattgttcagggaagactacggcttctatctcgccggtttcatcactgagcgttaaaaacgccatgttttgacctgttttcgtccgaatcgttttgatcttcgacagcagaacgcctagtgaaagctgccttttgactgcccgctgagcctgcagaatagagactgctccttgcgcagtgagctgttttcggaaggcggagaggggatgatttgaaaaataaatgccaagcgtttccttttcaaacgcaagtaaatccaccagaggaagctcctccgtctccacatacttcggcttaattgaaaacgattcatctaaaaacaatcccatttggtcatcgtccgcggcgaatagctcagcatgttccaaagcaacatcaatggatgcgagcagcgtggcccggttttggccgaattcgtccatcgcaccagaaaagataagtgcttcaagcattttgcgatttacgctttttgacggcacgcgaaagcagaaatcgaaaagatcttcaaatggtttctcttttcttgctttatatatatctttgactgctgagacgcctacactttttatcgcgcggaggctgtatctgacagatccgttttcaactgtaaacggaaaactgcttttattcactgacggaggaaggatacgaatcccgctcccctttgcttcgtaaagatattgagagattttatcctcattgccaatgacgcttgtcagcaatccgcacataaaatataacggataatgagctttcaaatacgcaagctggcacccgatcatgctgtatgccaccgcatggcttctgttaaagccatagtttgcgaatttgacgattaaatcgtagacctcatttgcagtgtctacagaatactccttttttaagcacccttcaacaaaatggcttcgctctctgtccaggatttcttttttctttttgctgaccgcccttctcaataggtccgcttcgcctaaagaaaaccccgccatacgggaagcaatcatcataatttgttcctgatacacaatgacgccatatgtatcttccaaaatgctccttaaatcttcatgaggatagtgaacaggcgcccggccgtgtttacggtcgataaataacggaatattttccatcggacccggccggtacagtgcattgaccgccacaatatcttctaggcccgaaggtttcagccgtttcaagacgcttctcatccctgcagattcaagctggaaaatgcctgtcgtatccccttttgacagcaaggagaacgttttgtcatcgctgtaggaaatacttgaaaggtctattttaatattttcttctttttcaatcattgaagtgatggattcaataagtgtcagattcctcaaacctaagaaatccatttttaaaaggcccaagtcttcaagatggtccatcgcgtattgcgttaaatagatcccttcatgcccttcttgaagcggaacaacatctgttaacggttcttcactcaggacaacgcccgctgcgtgggttgatgcatgccttggcagcccttctattttccgggcaattgaatagacttgctgaagcaggcttgactcccgaagccgcttatccagctgcggtgactgctgtctcgcttcatccagcgtcattcccggtcttgaaggaatgagttttgcaagctgatctgcctccttcgggctgacgccgaatactctgccgacgtcccggagcgccgcctttgccgcaagtgttccaaaggtgataatctgtgcgacgtgcattgcaccgtatttctgctgaacatattgaatgacttcatcccttctagtatcgggaaagtcaatatcaatatccggcatgctgacgcgttcgggatttaaaaatctttcaaacagaaggtgatgcttaatcgggtcaacatctgtgatatacagcacgtatgccacaagagaacccgccgcagaaccccttcccggtcctgtaacaatccctttttcatgggcgtgcttcataaaatcccacacgatcagaaagtaatcgctgaacttcatccgcttgatgacatcaagctcatattgaagacggcgaaggtatcgttcatcaggcttgccgaaacggctgcggagtccctccatacagatatccgttaaataatcatcagcggacgttccgtctggggtcggaaaagacggtagacgggtctgcccgagactgacgtcaatgcggcattgttccgcgatctctacagaagcttgcagtgcctcgggatgctctcgataaatgttttgcatttcttcgtgtggtttcaaatcgagatcaggcaaatcttcagcgggtgcatccgtcagtttttcccccgctttaatcgctttcaaacaacggtaggcagccttatcttccttccttatgtaatgcacatcgcctgtggccgtaacagggatacccgtttcttctgacagctttagaatctgctcagacaagacttgattccctttaaaaggctgataggagaaataaaaagctccctttccgaatatagactgaaattccagcgaggcttgagcagcctgttcgaacagtcctccttcaagaagcgtttcaatatatcctttttcgccgggcgttattgcgataatcccttctcgataactgtgaagccatttcggcttcagtccgccttttgatttagattgcagaacgctgctgattttcagcaggttttgatagcctgtatttgattttgccagcaggacgagcgggtatgcttcaagttcgctgtcatctgtaaaaacagaagccgtcaaaccgattattgggttgatccctctcgtcttgcaagctttgtaaaattgaatagctccgtacatgacatgatcatctgtcagcgccaaagacgcatatccgagcctgtcagcttcactgacgagctcttccacagccgcggcgctgtttagcaggctatacccgctatgcacttgcaggtgaacaaaagacatgctatcacctctttctcattacgattcatttcttccctcattataaggccggtttccaaaagaaacaaatgttcttttttgactcatcatcatacttgtcctgaaagctcaatatgatataaaaggtgaggtgataaagatggatcaggaagcaggatttatggtgaattttatcaatagctacttcattgcgttaggggtgctgatcgggggcgcactcattggagggctcggagcatatttggcaggcgaacccccgcttacagccattacaaagcttgccaaccggttaaaaatatgggcgcttgtcgcagctatcggaggcacctttgatgcggtatacagctttgaacgcggcatactcgaaggcaatacgagagatatctttaaacagcttcttttaattatttcggccatggggggcgcgcaaagcggctggcttattatatcatggctgacccaggagcatctttcttcatgagggtcccccagcattacaaaaaaccgggatggcagcgttttttcgcgggaatgatgtgcggagccgtaatcagctggttctttttcctgtttacttacggaacattccaagaggagcaggtcagcctcatcgaaaagcaaaaagagcatgtaaaagacttgaacaatcaaatttcgatctatcaggaagacctccataaactgaatgaagataataaaagaaaactgctgattcaaagcgtcagcgtcaaattgctgaatggggataaatataaaatatcacagccggataaaacgaaattcgaggagcatgtaaaggatgatatttcagaggtgattacaaaagacatagagagcgtctatcaaacaaaggatctcttgaagcggacaattgaaaataaagtctatatgatcaatgaaaaaaaatacgaggcaaccgtcagagaattgattatttatacgaggctgacagtggaacttgaaatatctttcgccacataattatggatttttttcaaattctccaaacttctgtcgctttttcccattcttttttataaactatatgtgaggcttaatggcgaaaggaaggaggaagggaaatggaggtttacagtgaccgtcagttagcaaaagatcaagcagcccgtctcagacaaggtttttctgcatatgccgaaacaaactcactcgcttccctcatcaaaaaagaacttcaatcacacaatctccaagtctacgaggaccttactgatttcggctgctggttcatccccgtcacagatgaacactaagagagagggtctcccctctactcgtgttctttacataatgtttccagatcagctaaaatccgatcagcttcatcccagctgtaaatagaggcgcctgaagctaacggatgccctccgccgttatatttccgggcaagtccgttaatgacaggccccttcgaacggaatctgactctgatttgatcgtcttcttctacgaaaaacacccaggcgcgaatacctgagatattgccaagcgtcccgacaagctgtgacgcttcagaagccgttgtgccgaatttttcaagcgtatcctttttgatgaaaacagaagcggccccgttttcggacaaagacacattttgaaagataaagccgttaagcttcaccacattcagttttgtttcatacaattgattaaacaactctgaggaagagaatggatactgaatgagctcgcctgcatattttaatgttttttccgtggtattcggaaataaaaagcgtccggtatctccaacaatgccggcgtagatcagctctgccgctttcgtattcagcttccagccgtgctcttttccttctaaatacagctcgtaaatcatttcacttactgagctggcgcttgtatcgacccagagaaggtcaccgtatggatcttcgttcggatggtggtcgattttcattagtttggcgcctgaaggataacgctgatcgtctattctttcctgatttgccgtatcgcagacaatgacaagtgcgccttcatatgtttcattgtccacctcatcaagggaatataagaaagagagggacggttcaggcgtgccgaccgcaaaaatatttttttcaggatatgtttcacgcaggatttccgtaagcccgcactgtgatccgtaggcatccggatcaggacgcacatgtctatgtaagataatcgtgtcatataatgatatggttctgatcaattctgttttcatttgatactcctttattgtttttattcattaaatcacattctctgccgacggaaaagaaaaataacgtcaaaaccaagcccgtttttgtataaaatgggtttgtaaacttttacgatggaggatttcatttatgctggttcttgtttttttgattgggctttccgcctgcttttatgtgtactataaagtaaaaggcgtacgggcaaagccatctttggcaaaagaaatatgttcagcaaaatcaagcatggccttagggtcactagtcctgttctacgggctcaaccaaatgatattattccattcagtattaacgttaataatcggcggtatctttatcgtcataggagcaggaagcgcttgggcaggttataaagcctttaggcattacaatccccttcacgccaaagaagctgaaagagatcacgcgtaaggggcgcctgaacgtcccttagcttctttccatcagctgaaccatcagcatcgctttagacacgatatgaccttggctgtgcacttccacttccattttcccgaactttctgccagcctccaagatgcgaggtttgacttcgatgactgattccatctgcacaggcttcaaaaagaagatggtgatgctctctatgacgagttcgccgcgttttttcgagcgcaaaaatcggtttgccgcttgcgtcaaaatggtcgtaaatacgccataagaaatggttccaagctgatttgtcatttgcggcgtgacttcatactcgtaaaccgtttgatcttctttatcatcaccctcatctttaaacccccttgaaacgatatcatcaagcttctccccgacctgcggctgcttttgaatcatttgaagagctttcaatacgtcttggcggctgatcatgccgatgagtttttggtggccgtcagtgacgggaagcacttcgatcccttcccataccatcatttgcgcagctgaagcgacagatgttttcccaataaccgtgacgggatttttggtcataactttttctatagatgcatttcggtcatggccagcaatatcttttgatgtcagaatgccatggattttcatttgatcgtcgacaaccgggaagcggccgtgccccgtttcaaaatttttctcataccatttttcaagtttatccttaggcgaaagatataccgtgcggtcagcaggtgttaggatgtcctccaccaaaacaatttcttttttgatcagctggtcatatattgcccggttaatcatcgcggcaactgtaaaggtgtcatagctcgtggataaaatcggcagttcaagctcatctgccagctgcacaatgctgtcatccgtgttaaagcccccggtcaccaatacggccgcgcccgcttcaagcgcctgcctgtgtgcattgattctgtttccgacaatcaaaagattccccgctgcggtgtaacgcatcatcgcgtcaagctccatcgcgccgatgacgaatttattcaatgtcttatggagccctgccctgcctccgagcacttgtccgtctataacatttacaacctctgcataggtaagcttttcaatgttctcttttttcttttgttcaattctgattgtgcccacacgttcaatcgtgctgacaaaccctttattctctgcttccttgatcgctctgtacgcggttccttcgcttactttcatttcctttgcaattcttcggacagaaattttttcaccgacaggcagtgaatcgatatacgttaaaatttgttcatgcttcgttgccaagcctttcacctctaaggacagtcttcttgtttttattataaggtttcaaaggatttatacgcaatgaggctggaaaataaaaaagaagcccgaccggcttcttacagcgttgatttcgtcccagtcaagcgcaaggaccccgtggctccttttacatcgtaaagcggaaaaacctttatttttcttttaaatggacatcaaccgctgtcttaacaatatttcgattccctattttagataaaacaaataaaactgcaaatagccatatcgcccctatggccgtatagatcaatggataaacagctttgtttgcgatccattcatttattaatgttctggcatttaccagaataataaatcctcctacaagcacacccatcaattgcggatgaaacttctgcaccagccatgctgcgataggggcagcgataattccgccggccattagtgaaaacacccataaccaattgacgtcctcccatcctaatgaaataagaaaaccggcggttgcagatacggcgatggcaaattcacttgtgtctacagtcccgacaactttcctcgggctcaagcctttgcgggataataaaatcggagtggtcaccggtccccagccgcctccgcctgtggcatctgcaaaaccagcgatcactcccaatgggatggattgttttcggtttaacggcacatgcttcttctcaagagccggcttatattgaaataaaaacctgatcaatacatatccgcccagaaggagcaaaaacaaagaaatatagggtttcgccacatctccaggtaattggctgaggaatgccgcgcctaaaaaagcgcctatagagccgggaatgacaagctgataaacggtttgtttgtcaacattgccaaatttaatatgcgacactcccgatgcggcagtcgttacgacttccgctaaatggacagaagccgaagccacagcaggtgtgatgccaaacgccaataacaaagaagttgaggtaaccccataagccatacctaacgaaccgtctattaactgcgacaataaaccaataaatgcaaaaacgattaatttcttcatcagaacaccccatctatatcaatcagatatttttgactcttcattcgaatctaacaatctcttggcgctttcatataaaaaataagaggctttgataatggcagtttcatcaattgtaaatgcagggtggtgccaatcatgatcaccgtctgttccaaaaaacgcaaaggatcccggaatatgctcaagataataagcaaaatcttcccccgcggttgatgggtcgggatcaatgacttgaagtttcgctttatgcgcagcgtctcgcaccagccccgtaattgcctcatcattacaaagcggcggcggtccggaatgccacttcacatttgcctttaacgagaatgcggcagaaatctgctctgcgactgccaaaaaacgctgtttcacttgatcacgaacctctgaatcaaatgtacgaacagtgccctcaatgacaactgtatccggaatgacattccaagtgctgccgccgttgattttccctacggttaaaatcgcgctttgcagcgggtttacatttctgcttacaatcgtttgcagggcgacaataagctgagaggcgccgacaattggatcaaaaccattatgcggcaatgctgcatgagcacctttcccttctatctttactttaaatcggtcaacagcagccataagcgggcctgtttttaaccctacagtcccaaccgcgatatccggtttattgtgaagtccaataaccgcatcaatgccatccagttggccgtcctctatcacttttgcagcgcctgcacccgcttcctctgccggctgaaataataaacgaacctttcctttcagactgtcttgattttccttcaataaaaagaccgcaccaagaagcgctgccgtatgaaaatcatgaccgcacgcatgcatgatccctttatgtttagacgcataaggcaatcctgttttttcttcaattggcaaggcgtcaatatcagccctcaaagcaatcgccggaccttctgactcccctgctatgtctgcgaacacacccgtttttagagcagtagggcgaatctgtatccccttttctttaaggcatttttttataaaagcagttgtttcaaattcttcttttgacagttcaggatattggtgcaggtgccggcgaatgccgatgagctgcttttctagcgttgagagatttacgggattatactcccctttcaacttcaggatgtcatttcctgtagtctgatatggataggagccttctatatttctccaataatccaaagacatatgtaccgctcctttccctatcccaatatattttcttcagactcttcaacataagatgaaataaatcggttcaatttatcagcaagaccgcccgccccaaatcttatatacttgctggaaactttcggattatcttctttcaaaaaacttaaaaaagataaaatataaatgcgcctgtaagctacttgtgtaattccgtactcaaaaaaccagttatcaatgacattgtatacgcctcggttgacgccatataggttgttacatttcttgtaaaagcagagatccggaagatttaactcctgatgggaaagcaggctttcttttttgttcggtgccataatcccaatcagttcaaagcgttttgcaacgcaccaaatatcctttttaatttgctttgttaaagactccaaagaatcaaaccttctttcttctctaattttaaagagaatgctgcattcgattttttctccatagatgtctctatgaaagtcaaacaaaaaaatctccaatgtccttttaaggttagagcccaccgtcggtttcacaccgatattcataacccctaaatggaattggtgattgactgtcgccagaactccataaactccattacgcagcccatgcatttttgcatctacatttgccgtggggaatccaagctttctgcctaattgttttcctttcacaaccgtaccggcaatgatcgtcaaaaaagtcagcctcctctctcagcttccgcattcgatcagacgaaacctaatgatgtgatgaatgtaaaacggattgatgctgcggaatgccaagaccgagattttcccgcaatgtcccgccgcgataatcttgacgataaagccctctttcttgaagaatcggaatcaccttttctacaaaagcatcaagtgttcccggtatatccgacccaatgataaacccatccgccgcctcagcgttgaaccaagtttcaattaaggatgcgacacgctctggtgttccgatgaatagagtccgtggaaaagccatttcctgtgctacctcccgcaatgtcagatttctggcttttgcttctctcttaatccggtctgttgtgctttgaaacgcattctttcccacatcgccaatatcgggaaatggctcatccaacgggtaaacactcagatcataatcatcaaaaaaacgagccaaataagtaacagcattttcaatcggtatcaattctgcaaattcacgatacttcttttccgcctcttcttccgtatctgccacaatcgggctgatccctggaaaaatccgcacacttgaaggatcacgcccttcatcagcagctcgccttttcacatccgcataaaacgcttttgtctcttctaatgaattggaatgggtaaaaatcgcatccgcatttttggcggcaaactgccggcctgtttctgatgaacccgcttgaaacactacaggctctccctgtttagagcgcccgatattcaagggcccctctacttgaaaatactttcctttgtgattcaggcgatgaagcttctccggttcaaaaaattgccctgttttcttattgtgtataaatgcgtcatgctcccaggaattccacagcccgcgcacaacatccaaatgctcctgcgcgatttcgtaacgctcagtgtgttcaggcagattggacttactatgattgcgcgccgccccttcctgcggcgaagtaaccagattccagccggccctgcccccgctgatatggtccagcgacattaattgtctggaaatagtgaatggctcagtaaaagatgtagagaacgtccctactaaaccaatatttttggtaaccgatgccagcgcagataaaatggtgatcggttcaaaacggtttaaaaaatgaggaatcgatttttcagaaataaataagccgtctgcaatgaaaataaaactaaacaaacctttttcagctgtttgcgcctttttcatgtaaaattcaatattcgtgctggccgagggatcaacatcgggatgacgccagccgtcagttgttcccccgacaccgtgaatcatggctccaaactgaataaaatctgaacgtgtcatctttttgcctcctttatctgtgcatgattagcaagtgcaagatcaaggtgttcaatgccgatttcagttatcccttgatagtgattgccgcgcccgatttcgaccacaggcacatggcgtaccccatatttcgcctgtaaaatatctcgaagttcctctttctctgaaacatcgatattttggaacgggaaccctttttcattcaaataattcttgacttcctcacaatacgaacagccttttttactccaaaccacaatgttcaaaacatcactcattcttctgaacctccttaacgttttgcagctaaaactgcatcgctcagcagctgataagacagctgtttttcttcagtatttttgatcggtgtaaaaataacaaaatcattgattttgtatgtgcctgataaacgtgttaattcttctgccacttcttcctttgttccggcaataatcccggttttttgcacgatgatgtcatagggctctgtgacgttttccagataggcctcagcctgttcgcgggaaccgacgttgaccttacgcccgtctttcaaatccacttttatcgattcacgcgacacaatatgtttttccgcttcttcttttgtatgtgccgcaaaaacagcgggggcaagatgaaattcagcctcagatcctggcgggagatgcgcgtcaaatgctcggcgggcttccttcagcacttcctcttcaccgttaataaagtaagcaaagacaaaagagattcccagttttgcagccgaaatggcactctctgcgcttcctcccaatagaaaaatacccggcttctgatcaacctgcggcctaggacgcaatgcggcatagcggtgggtatcaggaaaatcatcccgaacgaaatgagtaagctcctccagtttttcatcaaactgacgcaccggttttttatattcggcctgcagcgcgtctgtggacagctgaaacccgccgggcgctttgcccactccaagatctatacggccgggagctaacgctgatagaagatggaattgctccgctactttataagagctgtaatgctgcagcatcactccgcctgatgctaaacgaatttttcttgtgcttgcagcaagatagcctaaaagaacctcgggtgcagaccctgcaatctcatcattgttgtgatgttcggccacccaaaatcggtgatatccacactcttcagccatttgtgccaagttcactgtatgctgtaatgtatcagctgctgtctccccttcaccaatcaagctttggtctaaaatacttaagcggatcatatcaccggctcctttatgtgttcttttggttcaaataaatattccggcgaaacacggcggagaaactgcctcgttctgtcttttttggtatggcgaaagacttcctccggggttccttgttcaacaatgactccttcatccataaaaacaacttgatcagagactcttcttgcaaactccatttcatgtgtaacaacaatcatggtggctccggttttcacgatttccagcattacctcaagcacttcaccgaccagctccggatcaagcgctgccgtgggctcatcgaacagcagcacatcaggatgaatggcaagcgcccttgctatccctaccctctgcttttgtcctcccgataactgactcggataagcgttcaatttatcttgaagcccgacctttctcagttcattttccgctacggcatacgcgtcttgttttctcattttccgggcaatcgtcaagccctccatgacattttcaatcaccgttttgtgagcaaacaggtggtattgctgaaataccattgccgtctgttttctgagccagtgaacctcttttttggacggaaagctgcaattaatcactttgtcatgtatagaaatgatcccttcgtctggacgttctaataaattcaggcaccgtaaaaaggtggttttccctgatccgctcggcccgataatcgtcacaacttctcccttgcgtaccgtgagatttatcccttttaatacatggtggatgccaaactgtttatggatatttttaatctcaatcataaagtgcctccttgaaatctggctgcctttctctctaatactccatttgcggattctaggattagagtcagcacccaatagataatcgctgctccgataaacgcttctaaaaatgcataattatcagaagcaacgatagtcgccgtccctgtaatctctgggacagccactatagccgcgatagaggtggtatgcaaaaagccgatacccaaatttgtgaagtttgggatggaaaccatcagcgcctgcggcaatattacacgccgaaaggtttggctgtgtgtcaagccgattgaataagccgcttcgacctgtccggtatccatcgccagaatgcctgaccggatgatttctgtgagataagctccggcagttaaagacaaggccatgatgacaaacatggagaccggtatctcattggcggaccagccgagatgaaaaaaactgctgacttgatctgcaacaggaggtatccctaaataaatcaacataatgtgaaggattgcaggtgtacttcgaaagaaagacacataaaaccttgagcaagccaccaagcccttaattctaaaaattctaacaattatatttccaagagccacgagaaatccaaacacaatcggcaaaacagccatcatcaatgtcagaggaatggtctttaccatttctttcatggcggaaacgataaatggaaagtcaaattgcaatcttctcccccctcatccgaagaaatatatcaatgtatgttcatgtcaaaaacagtaacaatccttgtttgattcttcttgattcgtttttctgccactcgaaagaaccattcgaataaaactgcaacagcataataaacaatcgatagcgcaatgtaaacttcaagagaatggttgcttgaggtaatcagtgtttggccccttccggacatatccataacacctattgaaaaagctagagatgtatcttttaaagaactgatcaccatgtttcccatattcggaaatgcctggacaagtgcctggggcagaacgattcgcctgaaggcctgactaccgcttaagccaatactgtacgccgcttccgtttggcctttatctacactgcccacccccgctcgaatgatttctgcggctgccgctgcattgcttaacgcgtaggttgcgacagcagcataaaacgggtccatttttgatgtatcaatcccgataagtcccgtaagcgccgggattccgtaaaacacgatgaaaagctgcaccatgataggcgttcccctgaaaaatgagatatacacttttgccaattgatttacaattggaatattgtagatgcggggcagtgccagaaagagtcctaatacaaaaccgaaaagcaaggacagtgttaaaatgtataatgtaaccggtaaataagcggttaacgtcggcacaaaatctccaatcatgttcatatcaaacgctttttccatcactgctccctctcttttcacctaatactgctctttggaatagtcgtcaccaagccattttaaactgagttttttcagcgttccgtcatcaatgatttcctgtaaggctttatcaatatcgtcacttaacgtttgttcatttttgttaaacataaaatacactttggcatttgaaagcacatgaccgacggttttttctttaatagcgctcgtcttgttttgaaagtctactgcaaaaggcgttgagatcgttgcgtccgcacgccccgatttcagctgattcgcagtctcatttgcgccttggccctcataggcaatctcaaacggccgtccattatcctcattccattttttcagtacaagcgctccgttggaggttgcactcgtaatcacccgttttccttttaagtcttcaattccacggatcgtatcgttattttgaagcacagtaatttttaaaggaaaatggttgtaagcaaccttgttaaacagaaattttttctcacgctctttgcttttctccatttgatgtgccacgatatcgactttatgctgtccgaggctgacaagcaggttggaaaattccatcgttttaaatgtgaatttataatgtggcaggcgcttatcaagctctttgatcagttcgacatcataaccggttaaatcgcctttttcatcaataaagcaaatattcggaaattgggttccagttccgaccgtgatcgtctgtaccttcttttgcccggctcccgtcgtttgactgcctgcaccgcaagctgacagaactgttataagcgaaaataatattgccatgaatgctgttttcgttttcatctcatcgccccatttatttttcaaaacttgattttgaataatctgccccgagccattttcggcttagtttttttagcgttccgtttttctccagctttttaatcgcttgatccgtgtcatccgccaaggtttggctgcctttattaaacataaagtacacctcggtatctaataacacgtcaccgactgtcttttggcggaaggcgtgcgttttattctgaaaatcgacggcaatcggtgtagctatcgttgcatctgcgcgcccggtttcaatttgattggcggtatcattgcttccctgtcccgcatatttcaaatgaattgggctgccgtgcgttttgttgtactttgtaatataatctgccgcatttgacgtggcgccaactatgactgtttttccgtgtaagtcttttaatgtatgaatcttgtgattatcctctttcaccgtgatgtacatcggcgagtagttatatgggactttatgatacaaaaaacgcttttctcgttctttatttttggccatattgtgcgcaatcacatcaatttttttatttccgagactcgtcagcaaatttgagaaatccatcgttttaaattcaaatgtatattgaggcaactccttatcgatggctttcatcacttcaatgtcatacccggtcaattcacctttttcatttaaaaacgcaatattcggaaaatctgttccagtgccgactatgaccgtttgagcctgacgatctgttttgttatttgtttgcgaacatcccccgccaagtaatgcaaacactgacagcagcaaaaccaatcctttacgcttattcataggctgcctcacatcatgcccagctgggcgcacctaaaagcgttgggttaaatcgttccggaatcagaaccttgtgcatcatcacacctatgtccccgtctttttcctgctcaaaatacacttcataccctctccttctgtacatgtcagcaagccaaggatgcttgcgcgccgatgtgccgagtgtcagcgcaggagccttcagcatatctcgaagcactttttcttcaacatacgtaagcagcttacttccggcgccttgccctttatattccggcagtgtcgcaaaccaccacacaaatggatattttgaaggaggcgtctcactctcccacgggaacctgattgtaatcgttgaaatcagcttcccatcccgctccagcacaatcgctgaatgatgttcaatattttctgataccatttggatatcagctctcgtggatggccaatcaatatccagctgccgaatgggctgaaatgcgctgttaaccagtttcaacagctccgatgcatcttcaacagttgccagtcgaaaaatatcatcactcatttttgtcactcctcttcacaatatatataattcctatttgtttactaatcttttattgtttatactataaagcatactctgatctttgactaatcaaaaaaagtaaaccttcacttcagtaattttaatgatgaaaaacaggagggagaacattggagttacgctcaatcaaaacgtttcatacgattgtaaaatttggaagcttctataaagctgcagaaatactcaactactcgcagccgacgatatcgatgcgtatgaagcaattggagcaggatttaggcgtactgctgtttgaaagaggaaaaagcctgcagctgacaaaagcagggaaacttttttatgaacgaacaggagatcttttgatgcaatacgaggcgcttaaacacaacctctccgacttaaaggaagaagaggcaggcattatcaacataggggtttcagagccaaccgccagtctgatattccccgagattttaaaggatttcttaaaggattacccaaagataacagttaatatcaaggttgatgacgccaatacctgcagtcaaaagctcttagacgggacgattgattttgcagtctgcggcgagccggagctgattcttgaaaattactaccatccatttttttatgacacattaaatgtgattgtatctgagcaacatccgctcgctgagaagaaggctgtccatttgtctgatttagcagaagagcgcttcatatttacgcccgccaattgccccattcgcttacaaattgaacagcatttacatagagaactcgggaatcgttacaaaaaaatggagctcacaagcagcatgtcacatgaatattacgtacgtgaaaacatcggaatttcaatctttaccagcaccgcacattctaaaccgttcaacggcactaaagtcattccaattctgaacctggatatcaccccgcccatagggctgttgacaaatcaaaaagaagttcattttgaccgcgccacgaaggacttgatcgcccggataaccaaacgttttcagcagcgcagcaaagaattggaaggaacctctgataagaccattacaggataactgaaaaaataaaaaccacctcctgattcatcaggagatggtttcacggtttaaagctcgatcgtctcaccgaccgacatgactttgccgactccgcccggcaggctgtcagcgaatgcttctgggtcttgttcgatgaccgggaatgtattgtaatgcaccggcacgacctgttttgcgcgcagccattcagcagcaagcttggcgtcttcaggccccattgtaaagttatcgccaatcggaaggaaagcaaggtcgatatgattcaattcgccaatgagtttcatatcagagaaaagtgccgtatcgcccgcgtggaaaatcgttttatcttctacagtcagcaaaataccggcaggcatgcctgtgtaagtgatcgttttgttttcttcatctgtgatggctgatccatgaaaggcctgtgtgagcttcacttttccaaaatcgaactggcgggagccgccaatatgcattggatgaacattcaagcctttccagcctaagtacacagcgagctcgttcggggctataaccaacgcgttattttgcttggcgatttgttcagtatcaccgacatggtcattgtggccgtgcgttaataagatgacatccgcttttacatcctccggctttatatccgttaatgaattccctgttaaaaacggatcaaaaataatatgatggtccttcgtttccactgtgattacagaatgtccgtgatatgtcactttcatttctttcacctcgtcacatgattttgatttttttattttccctttttaaaaagctgaaaaacttatgttgtttgattcttgttaatgacattgaggccaccggtggcttcaatgacagtccctgtcacaaggtctgagttctcctcacacaagaaagcgataatccgggcgatatcctcgcctgtaccggatcttcctatcggcgttttttctttgccgattcgcattctggcttcctctatcgatgcttctttcatgtcgccgacaatgtctcccgggcaaaccatgttggcggttatgccgaattcggcttcttcaatggcaattgtcttcgtcaaagaagccaagcccactttcgcagcgccaaatgccgatcggtgaagccagccgggcgcgtgagccgcaccttggaatccgtacgtaatgatgcgtccaaattgctgttttctcataataggaataaccgctttgaataaatgaaagacggcgcttaaatttccttccagcatgccataccattcatcatcagtataatcggctaactttttacgttcaaatatgtatggtcccgcgttgttaatcaaaaagtcgatccttccgaagcggtttaaggcagcctctgcaatacgcagcagatcttcttttttggtgacatcaccttttacaaattgcagccggtcaagacaatcgggacaggcttccttcaggcggctgactgcctcctcatcctgtctgtaattgactgttactgaatacccctttgcaagcaacgtttcagtcactttgcggcctaaacccttcgaaccggcagtaattaaagcatgtcgcacatgaatacctcccaaagcaacgtcgccgctttcaataaagtgtttcttcttctactttactataaaaggcttgcaatatcactttttacactttggcatacaaaaaaagctgcctgtacagacagcttattctgcaggagatgaagactcctgatcaggcatatcgacataaccgctttgatatgcttctgaaatgagccttgttgtctcctggctttcttgttcatcataaatatagcgttccggttcttttttcatcattctgcctcccatcattatagaggtaggttggctataatgacgggattttatgaaggaaattttaacaaactcctgctgctacgcaagctttcgctttttcaagcgcctgctttacctgtttgaatccggtgcccccggcgctcattcttttttcaactgcgtagtaagggtctaacacagtgtaaatatcttcttcgaatagtgtgctcgcctgctgaaactcgccaaacggcatatcgcttaaatagatccctctttcgatgcatgtgtacacaagtttcccgaccacttcatgcgcttctctgaacggcattccctttttagctaaataatccgccagttccgtcgcatttgaaaagtcttgttttgttgcttgcttcatgacgtctttgtttacagtcattgtttggatcatgcctgtgaagatttgcaggctgccctccaccgttttcaccgtgtcaaacatgccctctttgtcttcctgcagatctttgttgtaagcgagcggaagtcctttcatgatcgtaaacagccccatcatatcaccgtatacgcgtcctgttttgccgcggatcagctccgccatatcagggtttttcttttgcggcatcatgctgcttcctgttgcgtacgtatcgtcaagctcgatgaatttaaactcctgcgagcaccataaaatgatttcttcagagaaacgggataggtgcatcatcagcatactgctgttgcttaaaaactccaaaatgaagtctctgtcgctgacgccgtccaagctgttttcataaatggcatcaaagccgagcagttccgctgaataatcacggtcaattgggaaggttgttcccgcgagcgccccgcagccgagcggagatttgttaatccgcttcattgaatcctgaaaacgctccttgtcgcgctcaagcatccagaaatacgcaagcatatggtgagcgaatgaaatcggctgggcgcgctgcagatgtgtgtagcccggcagaatcgtttcaacgttcgcttccgccttttcaatcagcgcactttggaatgcctcaatcagctcgatgatgtggccgacatgattcttcaagtataaatgcatgtcagtcgccacctggtcattccggcttctgccggtatgcagcttgccgccaagaggaccgatttcgtcaatgagcattttctcaatgttcaaatgaatatcctcataatcgactgagaattccaatgctccctcctctgctttttgcaaaagggtattcaggccctctcggattttcaactcttcttctgctgtcagaataccgcattttttcagcatggcagcatgtgcgagagaccctgtaatgtcttcagcaactaaattttggtcaaatgatatggacgcgccgaactcgtcgacccatttttccggtgttttttgaaatcggcctccccagagcttcttcatgctttaatctgctccttcttttttacgatgctgttcacttttgtcggaagtccccaaagctcgataaatccaattgctgcatggtgatcaaatgcatcgtcttttgtatatgttgcaagtttttcatcatatagagagtattctgatttacgtccttctacaattgcatggcctttaaacagcttcacgcggacaatgcctgtgacatgcttttgcgtttcttttaagaaagcgtgcagcgcatcttttaacggcgagaaccataagccgttgtaaatgatctctgacattttttgctcgatgatcggtttaaagtgggctacctctttcaccagtgtcaaatcttctaattctttatgcgctttgatcagtgtcatcgcaccagggcattcgtatacttcccgggatttaatgccgacgaggcggttttccacgtggtcgatacgtccgacaccgtgcgcgcccgccatttcattcagcttcaagatcagctcagaaagcgagtaggaaacaccgtcaatggagacaggcacgccctgttcaaatgcaatttcaatcacttccggcgtgtccggcgttttttccagcggagctgttaaatcgtatgcaccttctggcggcgccgcccatggatcttctaaaatgccgcactcattggcgcgtccccagaggttttgatcgatagaatacgggctgtcaagattgatcggaatcggaatgccgcggctagccgcatattcaatttcttcttcacgtgaccactgccattcgcgaaccggcgcgatgacttctaggtcagggtttaatgatttaatggagacttcgaaacgaacctggtcatttcctttcccagtgcatccatgggcaatcgcctgtgcatcttctttttccgctatttcaaccagctttttcgcgatcagcggccgagataatgccgaaacgagcgggtattttccttcatacatcgtgtgggcctgcaaagaaataagcgcgtaatcctgtgcaaattcttcttttgcatcgatcacgtaggagtttgtcgcgccgacttcaagcgctttctgctgaacaaatgccaaatctttgccctcaccgacatccaggcagcaggcgatgacattatatccttgctcctgaagccattttattgcgacggaagtatcaagaccccctgagtatgctaatacgacttttttctgttctgacatgataaaaatcccctctcaaccgtgtttctattttgtataaaaataaattatatttaataaaaatacattttgtatgtatacactttaacaagtacgtttcgttttttcaagccttttacaaaaaaaacttcacctaaatttcaggtgaagtttcgtagtatttattcatttacttgtcttttctgatttctctgaccacatgtgcaagttcgggaataatcagcttattcattgccagctttaccgcgccgcttgagcctggcgttgagaaaacagcggtatgctgaatgacgccggcagttgctctcgacatgattgcggcagggccgatatcctctgtataactcagcatcctgaatatttctccaaagccgggcagttctttcgaaaacagcggcgttatggcttcaattgtgacatcccgatctgctatgcctgtccctccgtttaagagtaccgcgtctgtctgttcatccatgcagcccgcaagcactgaccgctgcaaagcatccttttcgtcttttacaatttcatatgcggcaatatgatgaccggcttcttctaaaaatgagatcatcagcttgccgcttttatcggtttcatctgtcctcgtgtcactgacagtaatcactttgcaccgaacgatatcgggagcttcttgtttatgctcttgaacgctcattggcccacctcttttatgttttctgtctgtcactatcatgcatcaacaaaaaagcacattcaagagaatgtgctttcatgcgatttattttgctaaacgaacaacgtcgcgcgcaatcatgacttcttcatcagtcggaatgatcatgacttttactggagaatgcggatagctgatgaaagcttcctcgccgcgcacgttattaagcgcaggatcccagtatacgcccatgaattctaaaccgcgaagaacgcgttctctgacttccacactgttttcaccgataccggcagtaaagatgatcgcatcgacaccgctcattcttgcagcgtaagaaccgatgtatttgtggattctgcttgcgaatacttcaagagccgtttccgcgcgctcatttccttctttcgttgcttcaacgatgtcacgaagatcgcttgagaaaccggaaatgccgagcagtccgctttttttgtttaatgtattcagtacttcgtcagccgtttggcctgttttctccatgatgtatgggatcagggcagggtcgatgtttccagagcgtgtgcccattgctacaccggcaagcggcgtaaagcccatggatgtgtcaatagattttccgccttcaacagcggcaatacttgctccgtttccaaggtggcaggaaatcaggcgcaagtcttttaacggacggccgagaagctctgccgcacgctcagttacatatttatgtgaagtgccgtggaagccgtatttacggatgccgaatttttcatagtattcatacggcaggctgtaaaggtaagactgctcaggcattgtttggtggaatgccgtatcaaatacagctaccgcaggaacatttggaagcacttctttgaacgctttaattccaacgatatttgccggattgtgaagcggtgccaattcagaaatatcttcgatttccttaatggtttcatccgttaataaaacagaatcgctgaatttttctccgccgtgaacgacacgatggccaattccgtcaatttcattcaagtctttaataatgccgaattccgttaacttattcagcagcattttaacagctaccgcatgatccggaatatcagttacttctgtatttttttcgccgttcacagaagttgtgaatacgctgtcggcgataccgattcgttcaactaaacccttcgttaaaacggtttctgaaggcatttcgaaaagctgaaatttcaaagacgagcttcctgcgttaattgcaataattttggacatgattgacgctcctttatactctgtatcaacaacttcgtttttcgtacttttttcccggtgaatatcaacatcttctccgaaaaatatctgacttttccatttaaacattgtcatgtcggcttttcaagtcaacttgcgtattgataacgcttacaataagaagtcgttattttcagacacattccctataggttttgtattgatgaacgcttacaatttgcggtttttccctctgtattttgtgtttcaaagctggattcaattcgtcaagtccggtcttcaaaagcataaataaaagcagcttaggcatcgacctcatacggctgtctaagctgcttttaaaacacttacttttcttttttaaaccattcatcaaattgagccatcatatcaagcatcgccttttgattggagaaagacggaagattcgcaagcagaatttgccccggcgctttcgtattctctccttgtttctgaagcacaaggatgcttttggcatgagcttcgtctttaaaaatagattttggcagctgcaacagtgcgttgatatgaaccttatctttgaaaaactgtttcagcttgccgctttgggagctctcaaacaaatgattcggaatcataaaaaataagtagccgcccggtttggtatgcttgacgctctgttcaataaacagatgatgagcgaaggaatggccttcgtcagctttaagctcaaacgcttctgctccttcgtcattcggataatagccgactggcagatcacaaatgaccgtgtcaactggatcgataaacaacggctcaaggctgtcctggtggaaaagctcaagctcttttttcagaaggttcgcttgggcataggcgatcttcaagagcacatcatcaatttcaatgccaaagctgtttgccgttttttcagacagctggttcagcacggtaaacagaaggttcccagttcccaaggctggatcaagaatggtcaattcctttttgtccgccataaacttattcaccaaatagctgatgaaaagcccgatcgtatccggcgtcatttgcctgtttggatgggagatatctttcattcctttaaggacggcaagctgaaaagccttgcgtacccactcatgctcatacgtgccgaattccgctttttcaagcagagcctgaagttgtttggttttctgatcagcaggcagtttcagctgatccgttttttcaagaaaatacatttctcctgcttcggcaagcgcctctatatatgaaatctgcaattcattctttatcataatcgctgcttcgtttaacagctcatacaccgcacctacatggtctttttgcatattgtgttcctccttgccatgaaaaaagctccggcggcagcctggagcttttttccctgcttacttcactaatgccttagcagcctcaattggcttttcatagttcgggtggtttgttgcttcgcttacatattcagcgtaaacgacttttccattctcatcaaggacaaatacggaacgcgcaagcagacgaagttctttaatatacacaccgaacgctttgccaaatgacatatctctgtggtcagacagtgtttccactttgtcaattccgttagcgccgcaccagcgcgcttgcgcgaatggaaggtctgcactgattgtgtagacgttgacatctccaagctttgcagcttcttcgttaaaacgtcgtgtttgtgcatcacaaacacctgtatcaattgaagggataacagaaataatcgttacctttcctttcatgtcagctaacgatttttcttcaaggctgttagtcagcactgtgaaatcaggagcttgatctcctaccttcacttcttgtccgacaagtgtaaccggaccgcctttgaatgtaatttcagccattataattcctcccttttgtatgtatgtctctatcatagtaaagtttcctgcaaactgcaaagtttatgccaaaaaaaagttaactgcggccagcgcagttaacctttttttaataattcatattgttcatttggttttgattttggccctgactttggttcttgttatttttcttgaacatttgctggatgcgttcgagtgtttgaggggctgcgtctaaaattttctctattaaatgggtattttcatctaaatgaagcattctgatgcctgtcgatccgacaattaaaaacgcgatcggcgtaatggacacaccgcccccgcttccgcctccgaaaggaagtttctgttctcttgtctcatcgtcttccgatttcttttcggccggctttccgccaaactcgcttccgcctgcggcgaatccaaatccaactttagaaacagttaaaatcacacttccatcaggcgtttctactggatctccgatgatggtgttaacatcaatcatttccttcaagttttccattgcggttttcattaatccttggatgggatggtctgccatatacgcttcctccttaaactgatgaatcattctttgaagtcattctagccgacggattcttctttaatacggatagctcccgtccgtatttgacgaatttgaaagctgcaagcatagcatgtccaaagcgaaaaaagaatatacactgaaaatgggtcttggaagcaggggcttgaaacgacgggatcacctcatagacaggtttattcacaaagtccaggtggtcgtagagcattgctgcgataccgcccttcacgccccatacagcacctgttaacacacctgtcactgccgcgtcctgaattccgattactgtaacccattctagttttgtgatatgtaaatgcgcgagaaaagacgcgctgattttccgtagtctggtgacctgatgcaaaagcatttcgattttattaatgctttgctgcacatcgttttgtgtaatttttttctttccgctgctttttttcattttagattcagttttttgtttgatatccactgttccgtcttctttgttcaccttaatcgccgggattgtttttttgatccttataaggccaaacagcgccgtaatcttcaaggtcaatttgtcattatcagcggcatgaagatactccagcgcgacatggattttcattctgagaagcagtacgatccctatgagaataagaatggctgtcagtacatacaccatattcttcacttcctctaggagcattatcgccaattcctaaaaaaataaacccggacggaggtccgggttatcggttatttgcggtataatttttcatgcaccacggtggtatccgcgatgtaatcatgaatcccttgttttgtaggtgaaaaagcaacaacgatatataaaatccaaatcttatcaatataccgtccaaccacttcacgaaaaatcactgtactccatgtcagcttgctatcttgcttcacagaaaccactttgaggccgaacaccattttaccaagcgtctgcctgaagtatttagtcattagtgcgaagtaggcaagatacacaataagcgttgtcacactgtaggccgagaaggtaaacatgccggatgttttcggcagatccaatacggtaaagaggggagaaacgagcaaatggtttaatccccatatcacgagccaatcaagcaggaaagcccagaaacgaacccaaaagccagcataggcatgtgtcagctgctccgcttcttgcgggcctttgatgtcattgcgctctaactcttcatatgtcgcgtccattattgttccctcctacttcgcatagagatacatcattctcggcgaaccggattgcgatagaatttctctcatattcaaaaaatcaatttcacttttaaacattttgttcgcgcccatggaaaacagtgagcctaatccgaagctttcctcataagaaatgacagaggcgtttttcaaatccttgtgatcctttttcatggccgtaatggtatcgtcataaaaaccaagctcatcaacgaggttcagttttttcgcctgccgtccgtcatacacgcggccgtccgcaattttctttacctctgctttcgacatgccgcgcccttttgaaatgacatcaacaaagccttcatacgaattatcaaccatcgattgcatgatgtttttttcttctttcgtcatctcacgggaaggagacataatgtccttatgggccccgctcttaatcgtttcataagaaatgccaagcttatcggcaagctttgaataattgacgctttccataatgacgccgagtgacccggtcagggtttccggtgtcgcaaaaaccttatcagccgctgttgagatgtaatagcctcctgatgctgccatcgaacccattgacacgtaaatcggttttttcgtttctttcttgatttcttccagtttcttatgtatttcagcactttcatacactccgccacccggagaattcaccttcagaacgatacctttgaccgtcttgtcatcttttgcgcgctcaaggttttttaagaacgttctgtggttatatccgtctgcaccaagcagactgcttgagtccccattatcctgaatggtgccgctgacctctaatacggcaattttacttgagagactgccgttttccagcgtcttttcctgcgattcatccgtcagtgatgtgagatccgtttgagcgcctttgacgctttcaaagaaactcatagagatgctgacgataatagacacgccgaaaatccccagagcaatcactaatgcaatccatctttttgcattcattttttctcctcctttttcctaaactctctcattatacgattcaatatgaaaaatgtttcacttcatgagaaagctccggcttaacgggctgccggcaaacgtggtacacttatggccaaaggtattttatcacaaatactggatggcagaaaaacttaaatatgacagcaaaggggaaatgggatatgaccgatcaacgccgtaatgtttatttttttcacaaacaggatcaggaaacgaacgaacaagcccgctcgttaacacaattagcggaagagcatggatttaccgttgtgaaccagcactcagacgccaatattatcgctagcattggcggggacggcacatttttgcaggcagtcagaaagacgaattttcgtgacgactgcttgtacgtcggcattaccaaaaaggggaaagctcatttatattgcgactttcatagtgatgagcgagaaaaaatggtcgatgcaatgacgtttgaacaaattgaagtgagaaaatacccgctgattgaagtgacagtggatcaagccagtccttttcactgcttaaacgaggtatccatccgctcaagcatcatcaaaacctttgtgatggacgtgctgattgacgatctgcactttgaaacgtttagaggtgacggaatgattatctcaacgcctacagggagcaccgcctataacaagtctgttgcaggagctgttgttgatccattgcttccatgcatgcaggtatcagagcttgcatcccttaacaataatacctaccggacactcggctcgccatttgtcctcagctctgaccgaaagctgacccttcgtgtggtgcaggacggcaacgaacacccaatcatcggcttggacaatgaagcactcagcacgagaaatgtgaaaacgatcgaaatcaaactgtctaataagaaaatcaaaacagtcaaactaaaggacaattcattttgggaaaaagtgaagcgtacttttttatagaaaataaaaggacaggctgctgcctgtccttttatgatttctcatatacaatctggccgttaatcacggtttttttaatatctaaaagatgaagctgtgcggggtcaatggcaaacggatcaccactgagaactgtaaaatccgcatcatagccttccgcaatttttccgcgtgacttctctttataaatgataccggcgctaccttctgtataaagctttatcgcttcatatacaggtaaacattcactttcattatagcttggcccgttttgctcatgactgcttttcctgaggaccgcggactggatccctagaagcgggtcaacaggctcaatcggggcgtctgaaccgcccgcgcataaaatgcctttagatatgagggttttccaggcaaatgcagtcttcatccggtcttttccgagacggtcaatgacccacggaaagtcgcttgcaacgaaatgcggctgaagatcaagtgcgatcggcatgcgtgctgctctctcgattaattcgttatcaagcacttgggcatgaataagccgatcatgccggccgtttttgggcggatgcttttcaattgcgttcagcactttttcaaaagcaagatctccgattgcatgaactgcaacctccatccctttttctctcgctttgcgaatgagccggccaagggtttcatcatcgtgaacctgaacaccatttgttgatggatcatcctgatatggttctttcaataaagccgttctcccgccaagcgccccgtccgcaaagattttcatcgcaccgaactccacatacgggccggacagcttctccagctgctcccatcgatcgaccgcttcatgatgaacgagcaaatggcagcgaaacggatactttccgccagcggcagctttctcataagctttcaacggcaccgaaacatcaccataataggacaagtcttccgaatgaccgcccgtcaggccttttgtccagcaatcctttattgcagccgttaatgcctcatcaacatagtgctgagagactggcgggacagccttcagaatcaaatcctgcgccttatcaaacaggagtccggacggctctccatttgcatcttttacgatgactccgccgtcagggtcaggagtatttcttgaaattcccgctgcttgaagagccgcagaattgacagctattgcatgccggcatatacgcttgagcaagacgggtctgtctggaaacaggcgatcaagatcatgcttagtcaagtagtcaggtgtcccaaactgattttcattccagccctctccaatgagccaatcgtttttaggaagctgccgctctctttccttcgcagcctgtaaaattgaatctttcgacgtcagtgcggacagatcgagctgaagctgtttctcaccgtggccgatcaaatgtaggtggctgtcaacaaaaccggggaacatcactgcaccgttcaggctgatttcttctgtttccggtgacccgtacttttccttcaaacgttcatagctgccggtgccttttatgacaccatcctcaacataaactgcctcagtccgatcgccttcttcgagcatcgtataaatgaaaccgccgtgccatatcgccttcattcacgttcactctctttctttacgcctttttattggctttgagctgttcttcacgttttcttaattccactcgtctgatttttgcagaagccgttttcggcaggctttccacaaattcaatttctctaggatatttgtatggagcggtaatcgtcttcacatggttttgcagcattttgacaagctcatcactgcgtttttcatgattttgcaggacaacatatgcctttacgatggagcctctgatttcatcagggcttgcgacaacagcacattcttttacttctgggtgcttaacaagcgcgtcttccacctcgaaaggcccgatcgtatagccggagctgataataatatcgtcatttcggctttcaaaccagaagtaaccttcctcatcttttcttgctctgtctcccgttaggaaataatcgccgcgaatttgtgttttcattctttccggatctttaaaatactctttaaagagcgcaggcgtactgaggtgaacagcgatatcgccaacctcaccaggtttgcagatttcaccgtcttcatttatgatctccacctgatttcccggtgtcggttttcccatgcttcccggtttaataggcgtatctttcaaaacaccaaccaaaagcgtgctttctgtttggccatatccgtcccgtaccttaatgccaaagtgcttttggaaaacatcaatgacttcacggttgagcggctcacctgcggaaacagcgctgtgcagggcagaaagatcaaagcgttccaagccttcaaccttcgccattaagcggtattctgtcggagtgcagcagaaaacattgattttgtagcgatttaaaagctctagatatttttctgctttgaatctgccgtggtacacaaaaccggttgctccgctgccaagcaccgctaaaaacggactccatacccacttttgccagccaggggcagcagttgcccagacgatatccttttcagaaatgtcaagccaagcgccggcagaagtttttaaatgagcaaatgcccatccatgtgtatgtacaacacctttcggctgacctgttgtcccggatgtataagataagaaagccatatcatctcttgttgtgtcagctgttttaaattggcttccgtccgcttcaattgataagaggtttttccagccggcatcattttcaccaatagacagtgtaatcagtttgtcagtcgtactgacatcccggaaagcgccaataaattcggagtagacgatagcgccttttacctctgcatgttcaatccggtattcaagatctttcgcgcgaagcatttcggagcacggaatgacaaccattcctgatttcaggatagccaaataaacagcataggcttcaagcacccgcggaaccattacaatcagcttgtctccctttttaaatccaagatcagctaaggccgctccgattttatttgtttcttccatcagcttttcatacgaccaagattcttgcttgcccgactcgtcctcccaaagaagagcggttttttgtccagcggcactgaacttttccatttcattcactaaattatattgcataggggcaattaaatcttcacgttttaacacgaacaactcctcactttctccacccattatacataaatacaggctctttccgtaaggatatgcctaaaagcaacctctgtaaacatagattttataggccgctggtccttttttatattataaaaaatgaaaaggagtggggatacccccactcctaagccattatgtgaaattgtaaattagaattgtcctccgcccatgttttgttgagcaaaagatacaagacgttttgtgatctctcctccaacagaaccgttagcgcgagaagttgtgtctgctccaaggtttacaccgaattcagaagcgatttctaatttcatttggtcgatcgcttgagcagctcctggtactaaaaggttgttgctgttacctgagttattgttagccatgtgtctcacctccttgtgagtatagaatgtgtcaaaacacatggcttcattcagaaaaactttggtaattgtatacaggagctgaaaattgatttaaaagagttcagcgaatttatcgttagcttcttgttcgctataaagggtcattgtctcaatgttatctaccgcttcttgaatatacggctcgaaatcaacaaagctttcaaagtgttcaattttctcttttttagggcgtgttttcgggcttggcggtgtaaagatcgtgcagcagtcttcaaatggctgaatgcttgtctcatatgtgccaatttcccgtgatttttcgatgatttctgttttgtccatggcgattagcggacgcaaaatcggtgttgacgtcaccgcattaattgcatacatgctttcaagcgtttggctcgctacctgaccgaggctttctcccgtaataatggcaagcccgtttctcttttctctgattctgtcggctatctgaagcatgaggcggcgggttgccgtcattgtgtaattttcaggaatttgtttttggatgagctcttgcgtttttgtaaatggaacaatatgaagtgtcatgcttcccccaaaacgggacagacatttcgccagatccattaccttttgctttgcgcgctcgcttgtgtatggcgggctgaagaaatgaacagcttctaccgacaatccccgtttcatcgcataaaaaccggccacagggctgtcaaaaccgccagaaagcatcagcatcgcttttcctgctgaaccaactggcagcccgcctgcacctttttcatcacgaattgtcaaaaatgttgcttcttccctgatttcgattctgagcgggatgtctgggttgcgaacatcgaccgtcaatccttctgtatttcgcaaaatatggccgccgatttcagcgttcatctggtttgtatctaattcaaattgcttatacgctctctttgtcgcgactttaaacgtatcacctggtttatactgatctttgatagcctttagtgcggttgccttaatatcatcaaggcggctgtcacatttaattgccaggctgaagctttgaatcccaaacacttgctttaaatgaggaaaaagagcctcaggatcctctccatttaatgtaatcgtcatacgatccctgttggaaaagtattttaaattcggatagtctttcaaaacgagtctgatgttttgttttaagcgctcaataaagctttttctgtttttgcctttggtcgaaatttccccaaaacgaattaatatatgatcgtaattcatgttctacctcatcattttccttaattttttgataccaggacgaagcgcgttcataaacggttctgccacatcgcttgtctggctgtaatttaaactgattctgatgctgcttccggcaatctgctctcctttgcccatctctaagagaaccttgctgggcttatgttcttttgccgagcaagccgatgttgtggagacgaaaatatcctgttcctcaagcatgtgtaaaagcacttccgctttaatccccggtacagagaaattaataatgtgcggcgcgctattcatttgaggcgtgttgataacgacgccctcaatttcactcagccttttcataaacaattcctttgcggcagtcatcgtgtcaagccgtgtgtcaaaatcagcagaggcaagattaatggccttggcaagcgaaaccgctccagcagtatgttctgttccggcccgtatgcctttttgctgagagcctcccgttatgagcggaataaggcgtgttccctcttttacaataagtgcgcctgtcccctttaggccgtgaaatttatgccccgaaattgaacatagatcaatgccggccttttcaattgccaagggcactttatagatgccctgcacataatcgacgtggaacaaaatgttcgggtgcttcttcagcacttcccctgccgcttcaatcggctgcacggaaccgacttcattgttcacatgcatcatgctgacaagcacggtatcgggacggatggctgcttttagatcttcaatagaaacaaatccgtcttcattcacagaaagataagtgatatcaaacccgaacaactctttcagctgttctaacgattccgtaacagatggatgttcaatagaagtggcaatgatatgtttgcctgtttttatctttgacaaagccgctccttttaaagccgcattattggcttctgtggcgcctgacgtaaatacaatatcatatttttttaggcctaaggaccttttgatttgatttttggctgcttgaagcagctgttccgtttcggctccatatcggtgcaaagatgaaggattgccaaagtatcggctgcttgtctgttcatatacgttcaagacttcatcgtaaggcttcgtcgttgaactattatctaaatatatcatcttttttactcctttatgaaagcggtacaaggtatgatatttatgttaccataacaaaatttaatagaaaattacgaaaaactagtattgacttctaatttttttaccatataataagatttgttcgtttcgtcatattatctgacaattaattgacagaatattttaacataattattaggaggatttttttcatgaaacactcactgcctgtcaaagataccattattattggtttcatgctatttgcgttattctttggagcaggaaatatgatttatccgccggaacttggacaagcagccggacacaacgtctggaaggccatcggcggatttttactgacaggggtaggcctgccgcttctcggcattatcgccatcgcattaaccggtaaggacgctaaaggccttgctgacaaagcgcaccctgttttcggcacaatctttactgtcgtgctttatttatcaatcggaccattattcgccatcccgagaacaggaactgtttcatatgaaattggcgctgttccgtttttgactggcgtaccagaaagactttctttattaatatttacacttatctttttcggcgttacgtactatttagcgttaaacccatccaaggttgtcgatcgagtcggaaaaattctgactcccatcaaattcacgattattttaatcattgttctcaaagccatcttcacgccgatgggcggattgggcgccgtgacagaagcatataaaggaacaccggtttttaaaggatttttagaaggctataaaacaatggacgcacttgcttcaattgtatttggcgttgtcgttgtaaatgctgtaaaaagcaaaggcgttacacagtctaaagctcttgctgcagcctgcattaaagcaggtgtgattgccgctttaggcctgactttcatttatgtatcccttgcttatttaggtgcaacaagcacaaatgccatcggtcctgttggtgaaggagctaaaattttatctgcatcttcccattatttattcggttcattgggcaacatcgtactcggagcagcgattacagtcgcatgtttaacaacaagcatcggccttgtcacatcttgcggccaatatttttcaaaacttattccggcattatcatataaaattgtcgttacgattgtcacgttattcagcttgatcattgcgaattttggactcgcgcaaattatcgcgttttctgttcctattttatcagctatctatccgcttgccattgtcattatcgttctttccttcatcgataagatctttaaagaaagacgcgaagtgtacatcgcatgcttgatcggtacaggacttttcagtattttagacggtatcaaagcagccggtttctcacttggatctttagatgtgtttctaaatgcgaatcttcctctttacagcctcggcatcggctgggtgcttccaggaatcgtcggagcggttatcggctatgtgctgaccttattcatcggaccatccaaacagcttaatgaaataagttaatgtcacagaacgcctgcgttattgcgcaggcgttttgtaataagaaaaagagcctgctcattacactgcgggctctttttcatggtcgtgattatctaagcggatatgtcagctttgattttttcaactgcacctggcgcagccttttctacagcggtagctgcaatttcataagagtcgtcataatcaaaagcataaaaacgtctttccgcttctttcagctgttcagataaaatatgattctggcttctgaaccggtttccgaactgaatgattttttcaatgaggatgacctgctcgacaagttcctctgattcccggcttgccctgttgacgatatcttctgcttgtttcaaatgggctccggcttcttccatatttaatggaagttcgtttagttgattgaccgtttcttgaatatgatgatgcgcgttctccagcatctcttgaatatggctcggaatgcctggaatgttgctagtcttcagcagtcttgctgtctcagaaattgtttttttcaaattgctgagcgtctccctcgcctgaagctcttcttttctcagcgcttgcagattttcacgatactcgtcatgctcttttttcacttcttcaatttgcttctctattgaagcaacttcttccactaaaagtgagtaggcaacatgctctgcatcgagcttatctttaacggatgatagcagcttcccaatttcatcaaggcgcttttcaaaagcctgctgtttgccgagctcaccggctgtcagcctgtagctttccttcaccagctcagtttccgccttcgtatgctctttctcttctttaagcttgtcgtaagcaataatcaattcaggcattttgcttagtacggattgaccggcttcaacttcgccctccagctgctgataaacagattgaatattttcgtcaatgagctgcaggattgcggacgcttcatcaatatccagctcagtcatcaggacatgttccgctcgtttcagctggtttgacagattttctaattccttatcaagctggatatgctcaagcttgtaccctttttctttcatttcgccatagccatccttgagctttgcaatctgtccgggcaccgtctgtttacagtcagctaacagcttcggcacatcatctatgtatgactgaagccgttcaagattgcggtcctgctcaagcagtacttttcttgcagtaatatagtttccgccttctgtttcttcttcaaattgtttgatgccgctccaaatttcgtccagatccttttcaaggctgtcataaagctccccgtaaaggtggctgtaagccagcaggttttttcgagatttcgaatagcgctccctcacctgttcaatctcttcacggctcttttcctcacttgtgacaagatcgctgatttcccgaagaatcttttcaatgcttgattcagccgctgtcagcaggtcgtcgatatgaacgagcacttgattggcctttttaaaccggtatttgtctgcattttcctcggcatcataaaggagctcttcaactttcggcatgtgggctgtgacaatctcatcccattcttcacgccacttctcaaagaactcttctgtctgacccgtcatttttaaatgttttattttagacatttcttccacgatcgaccgatttagaatttcaatcttccacgattccagccggtcgatttcggcgtagacttttttcctgaaaaagtagcctgccgcaaacagcgcaagcagtacaattaataatccaatgacaaactccataatgagcccccttgctgtttaccttaatctgtcagggtgttttatttattcagaaagatttcaggatatgtattgagaaaaactgtcgttttcattgttattatgataccatgtaacaaacattttttgaccagaaatcaaaaactttttgtgcaaaatcggcaggatttgactattttttcatggggtgacatcaatgcaaaagcgagacggacatattcacacaccattttgccctcacggctccaatgacacactcagacaatatgcagaagaagccttaaaaaaagggttcgaatcgattacttttaccgaacacgccccattgccgccctcttttaccgatcccacgccgctgaaagacagcgcgatggcgcaagcttctttggaacgctatattcatgaaatttccggattaaaaaaagaatatcgcggacagcttagtatacggacagggcttgaagtcgattatatcgctgaatttgaagacgaaattacattattcctggacacatacgggccatatttagatgacagcatcttatccgttcattttttgcgcacagactcttcctatctatgccttgattatgacgagcataccttcaaagagctgatttcagcctgcggaagcattgaagcggtatatgaacaatattaccggagtatctattcttccattgtagcatctctcggcgtttataagccaaaaagagtcggtcacatcacactcgtccaaaaattcatcaagctgtttccatacagcatgtcagaacatattcgcggcctcgtttccctgtgcctgaatgccattgaagaaaacggaatggagctcgacttcaatacttccggcttaagaaaaacttacgctggcggtatttatatcgaggattggatgctgaatgaagcgaagcaaaagaagatcccgcttgtgtttgggtcagatgcccatcaagcgggagatgtcggatatgcgtatgaggcgtttttggaacggtgctagttggtgagcgccacgtctcctgtccggaagacgcttctgatccaaatcttgatttcttcaaaatacattttataaaaatacggctcgtgcggctgcatgtagagtacttctgaaatatattgaggctggagatagggcatcatcaagagagattttaattggagaataaaatgaggcagcggcagcgttaaatattcacgctgtttttctccttcctcaatgatcagctggaagatatacttttccttcattagatatgtcgacataatttccctgattaatgtggagtcaattgtgacttcccggtagacaaaacgagttaattgacgatgattatgctgataggataaaatatcgaaaaccaattgaagaagctgttcctgagtgctttgagaagagatattgcttgccgctgtttcaagcgttttgctgtagccctcgtaaaactctgaaactaagtgttccatcaagcctcctttgcctttaaaatagtaggagatgtgcgcaacatttacatcagctgactttgcgatttcacggacagacgtgccagaaaatcctttttggttaaaaagcatgacagcagattcaataattttgtctttggtgcttactttcatacggctcactccttcctcttgatactattcaagcagaaagccgctgttcctgtaagaacttatcgacaaatgccggcagaaaagccggaactttgttttatattatagaaaaagtgagggttttccatgttccatgtcgaaaaacaatctggagataaagaaaaaggctatcagcttctgctaaaacagctcgaagccatgaccgaagacgaaacagatcaaatagctaactatgcaaatgcctcagcactgctgtatcattcgctgcctgaagtcaactgggcgggtttctattttgccaaagaagaggatggacagcttttgttaggtccgttccaaggcctgccggcatgtgttcggattcctttcggcagaggggtttgcggcacagcgtacgcaaacggaaaagtggaacgtgttgaggatgtaaactcgtttccgggacatatcgcctgcgatgcagcgtctcaatcagaaattgtgcttccgattcgtgtagacggaaaaattgtcggcgtcttggacatcgacagcccagtgaaaaaccgtttcgacgaaattgatgaaaaatacttaactcaatttgccgaaacgctagaaaaagcgttagcgcagtaatataaaagcccaaaactgatatcgttttgggctttttttattttattgagtcatgaaccatcaagcggtttttcccgctccgtttcgcgctgtagagcgcttcatctgcctcatgcacaagctctttcagcgacttttttgtttctgtcgtccagcaggagataccgcaggaaatggttacctcgggtttcgtattttttctgaccgcgtaaaccagtcgctcggtaatccgtttccccactgcaaccggcacatttggcaaataaatcgccagctcctctcctccccagcgggcaccgacatcatgctttcggatgttgcttttaatcactgaagcgacttgaattaaaatctcgtccccagtctgatggccgtacgtatcatttacatttttaaaattatcaatatcaacaagaataaaaacacccttttgatggattttcatgctgtattgaattttttcatctaaatacgctcgtgaatacagttcagtcagctgatctgttttcacgagatgctcaaggcggtcgcgaagcattgaattggttacagccagtgtcgcgtgatgaatcagcgcctgaaacagcttgtacatttcaaatgtaaaagcgtacagctcctgtttcaataaaaccgcaaagcctaaaagccggtcgttttgaatcatcggagcagccatcagcgagccgtaccccgccttcccaaaaacagactggccattcccgatgaaaacccctttttcaccttcatacagcttttctttcagctcattataaaaatctgacggcttcgcttctttaaaaaatgctgtgctgcctgggagcaatgttaggttttcaaaatggtctatatgaaaaaatcccacttcttctgcctgaaacgattctgccattctcacagccagatcattcattgtatcagtcaatgtcagccgctgattcaggcgtcgtgatgtttcattaatcaattccaaatttgcgatgcttgctttggattgttcgtagagctgggcattttcaaacgcttttcccgcggcgtttgctaacagcgacatttcatcaaggcaggcatcagtaagaaagctgtcacccgttccttcagccttcaacaccccgtatgtgccctgctgtcctttgatcggaatataggcgacagattcatttttccgcaaaatgtctccggacaaatacactttgagcgcaaaggaatcggatttttccccttccatatatagctcttttgcaggaatccctaaacattggtcttgatcgtgcgatataaataaagaaaactcaaaaagagaaaatgtgcttgtcaagctttctaaaagctgcttcagcacatctgtctgatcaagcagtgaatggaacagctctgtcattttgtatatctttttttggtagatcgttttgttatagagtctttcctgtttcatcgactggtttaaaaatgaagcaaccacgtccggaagcccttcaggaatctcttcatcctgcctgcatgcaagatggaaacgcctgccggagccgtcctcaatcagataacatgaagcgtttatttttgaagcggaaaaacgcgcttcaccatctgccagttttgtcacaaagtctgatggtgacggtgtaagcgaaacacacagggttgaaaaataggtttgaatagccgaagtcagccatatgaaagagtcggtgaatgtgactttttcagatttggttaataaaaaatcgagcatatgataatgaaaggcggataattgatctttagtttgttctaccatgtttttatcacctaaaagtttaccactaatttttgtttattatatcataaacggtaaagcaataatggaggaatggttgacttcaaaacaaataaattatataatgacctttgtgtgaaatattgcagcctttttgttcagcttctatgttttcattttgttccttatcaataaggtgtatcgtgtaactctctgctgctggagcgaggatacatgaaaacaaaatgtgcatggtcgaatagagcagacggtttttattttccacaaaaataaaaccaaaggaggagtcacattatggctcgctatacaggtccatcttggaaactgtcccgccgtctaggaatctctcttagcggtacaggaaaagaattagaaaaacgcccttacgctccaggtccacacggcccaggacaacgtaaaaaattatcagaatacggtttgcaattgcaagaaaagcaaaagcttcgtcacatgtacggtgtaaacgaacgtcaattccgcactttgtttgacaaagctggcaaactagctggtaaacacggtgaaaacttcatgattcttttagattctcgtcttgataacgttgtgtacaagctaggtttagcacgtactcgccgtcaagctcgccaattggttaaccacggtcacattcttgtagacggaagccgcgttgacatcccgtcttacctagtgaaacctggtcaaacaatcggtgttcgcgaaaaatcaagaaacctttctatcatcaaagaatctgttgaagtgaacaacttcgttcctgaataccttactttcgacgctgaaaagcttgaaggtactttcactcgtcttcctgagcgttctgaacttgctccggaaattaacgaagcgcttatcgttgagttctactctcgttaatcgttttaaaaacccctgccgctatgcggtcggggtttttttatcgtctgtttcgtcattcgcctcttgctggccaacactttcttgcgcctgctgctcccaatgatcccgctgcagccgttcttttgcaatcgtacacatgagattcacgctttagcgctcctttcatttaaaaggtggtgattggtcgtgtttgccctatctaatatactcttttcctttcattcctatgcggtaaacaaaaagatcctttgccttcagtggcaaaggatctttttcttatttatacgtcacaaggaagtattttttcttcccgcggcgcagaacagtaaattgatcttcgatgcggtcttcacctgatagggtataatttatttccgtctggcgttcaccgttaatgtaaacagctccgttttgaatgtcttcacgcgcttggcgtttagaaggagataatttagattgcaccaacacatctacaagtgaaagctcttgggtgctgtcaacttccatagaaggaacatctttaaagcctacttttacgtcttgagcagaaagctctttaatattgccgctgaacagcgcttgggagatgttgatggcttgctctagcgcctcgcgtccgtgaacaagtgatgtcacttcttccgccaggcgtttttgcgcttcacgtttttctggcgccgtttctgttttttcagcgtatgcttcaatttcctcttttgaaaggaacgtaaagtatttcaagtatttgacaacgtcacggtcgtctgtgttgatccagaattgatagaattcatatggcgatgttttttctttatcaagccagatcgcgccgccttccgtttttccgaacttcgtgccgtctgcttttgtgacaagcggaatcgttaggccgaacgcttttgctccttcttcttctgattttctgatcagttcaagacccgctgtgatattgccccactgatcgcttccgccgatttgcagtttacagtttttgtctctgtaaagatttaagaaatcataagattgaagaatcatgtagctaaattccgtgtacgagatgccggattcaattcttgagctgaccgtatcttttgccagcatgtaattgatgccgaaatttttaccaacgtcacgaaggaaatcgatcacattcattttgccgatccagtcaaagttgttcgcgatgacagctgggttttctgctgcttcaaaatctagaaatctggacagctggtttttgattttttgggaccattcggatacgatgtcagcagtgtttaatgtacgctctgctttttttccgcttggatcaccgatgaggcccgtcgcgccgcccacaagcgcaatcggatgatgccctgcaagctgaaaacggcgaagtgttaaaataggcagcaggtgtccgatatgcaagctgtctgctgtagggtcaaagcctgagtacaagcggattttttcttcattcagctgtttatttaacccttcttcatctgtcatttgctgaatcaatccgcggaaggataagtcttcaagtaagttagtcataagataaagctcctttttgattaaaataaaaaacgccccttcgtttacacgaagggacgattgattatcgcggtaccaccctactaataagagaatgcaaacattcgtcttatcactttgcctgataacggatcaggtccgttctttcactactgaaagcctggccggctttgtttgcaaaagcggttcatgagtgtattcgatatatccgtctgtgctgattttcaccggccatcagctctctggaacgtaaggatattctacttgtctcaatctttaccttttcatatgaagctatatcatttttaacataaataaaatcctgtgtcaacgccgccttttaatcctccattgttgacagatctccagccggcagattaagctcccatgccttcagcacgcgcctcatgatctttccgcttcgggttttcggaagcttatctttaaattcgatctcacgcggagccgcatgggctgcaagaccctgctttacaaataggcggatctcttctttcagtttatcagacggctcaaatccttccctgagtgcaataaaggctttaatgatttctccacgcaccgggtcaggctttccgattacgcctgcttctgcaatagccggatgttcgacaagcttgctttccacttcaaatgggccgacgcgctcaccggaggtcatgatgacgtcatcaactctgccttggaaccaaaagtatccctcttcatccatgtaagcagaatccccagacacataccagccgcccggcatgaaatacgattcatacttttcagggttattccaaatggtatgcatcatggaaggccagccctttttgatggcgagattgcccattcggtacggcggaagctcgttgccttgattgtcaacgatcgctgcctccactcctggaatcggcttacccattgaacccggtttaatatccatgcaaggatagttgcagataagctgactgcccgtttctgtcatccaccatgtatcatgaattcgtttgttaaaaactttatgtccccatctgatgacttccggatttagcggctcaccgacactgagcacatgccggagtgaagttagatcatatttcgcagccatttcatctcccgctcccatcagcatccgaaaagctgtcggcgcgctgtaccagacattgacgccaagctgttcaatcgtaccataccagctttccgggctgaaacgtccaccgacgatgacatttgtcgctccgttcagccacggtgcaaaaatgccgtataccgtacctgtcacccagcctggatcagccgtgcaccaataaatgtcttcttcctttaaatcaaggacccactttcctgtttgatattgctgaatcatcgcttcatggatatgcagcacgccctttggcgtaccagtggaacctgatgtatagtgaagcagaaagccgtcttttttatccatccattcgatatccagtcttgtgctttcctgtttcgctgcttcatcataattgatgatattcgtgccgctctcagcctctcccccgactacgaagacatgctgcaagtgaggcagtttgtctaccggtattctctccagcagctcaggtgttgtgacaacaacctttgcctcactgttttcaagccgatctttcaccgctccctccataaatgcttcgaacagcggcccggcgatggcgccaattttgattgcgccaagcataataaaataaagctcgggtgatctcggcataaaaataaaaacgcggtcccctttttccacatttccataccgtctcagcacattcccggctctgtttgattcttccttcatttctttaaatgtgtatttttcatcccgttttgcgtctttataataaagcgctactttgttttttcgaaacgattcggcatggcggtcaatcgcttcatacgccgcattcagtttccctgtctcatgccaagagaaatgtttctctgcctcggcccaatcaaaatgccggtacgtttcttcatagttttttaagttatgatccccctctattgctggtaacgctttcaaattcatgcccaaacatccccctttgctgaagttgtcacaattattatagtatatattcatattcttctcaatttttaaaatataaaccaggttgaaaacgctttataatttggtattcttaaagaaggcatgtatttttgataagaattgatgggacggtgaattagtggaacatcataaaacataccattcagcaaacatcaaaacagcaaccggctctttactgatagaagggcctgtctctccagaggatttggcaggttatgagtttcataaagatttaaccgcatttcgcccgcctcgcgagcagcatgaagcgctagtcgacattgcaggccttcccgaagggcgcattattattgccagagacggccgaaccattgtcggctatgtcacgtatttatatcctgacccgctcgaaagatggtctgaaggaaatatggaggatttgattgagctcggagccatcgaagtagcgccggactatcggggatgcgctgtcggaaagacgctcctgaccgtcagcatgatggatgaacaaatggaaaactacattgtgatgacgacagaatattactggcattgggatttaaaagggatgaaaaaagatgtgtgggaatacagaaagatcatggaaaagatgatgaatgcaggcggattggtctggtttgcaacggatgagccggagatcagctcccaccctgcaaactgtctgatggcccgcattggaaaaaacgtcagccaagaatcaattgagcaatttgacaggctccgtttttatcatcgttatatgtattaactgacactgacaaaggggaaaaaataatgattgttgagcaaatcatgaaaagagatgtcattacattaacgaagacagatacgcttgaaacagccatatgcaaactgaaggaattccatatcagacatctgcctgttgtagatgaagaacgacacgtgatcggcatgattacagacagagacatgaaacaggccagcccgagtatttttgaagaaaacaaacgaagcctatttctcacacgaagcgtagattcaattatgaaaaaggatgttgtctgcgcccacccgttagattttgtcgaagaaatatcagccgtgttctacgagcatggcatcggctgccttccagtggtgcaccatcaaaaattaataggcattttaacaaaaaccgatttgctgcggacgtttgtcaaattgacaggcgctgaccagccgggatcgcaaattgagataaaagtaaacgacatcaccaaaagcctcgctgagatcagcagtctttgccaagaccttcaagtgaaaatattaagcgtgcttgtttatccgcatgacgatcccggtgtaaaagtgcttgtcttccgtgtaaaaacgatgaatccgctgccgtttttgcaggcattacaaagaaatggacaccacgtcgtatggccgtcagagcaaagggatctgctatgagagacagtgtatttatctattctccatcctaccaaacctatatgtttcatcaggagcatccctttaatcagcagcgggttctgttaacatatgatttgcttaagacgatcaatgcctttgatgatggagacattgtcacccccagactcgcttcagaagaggagctttcccttgtccacacggacgattacattcaggccgtaaagcttgcgggcgccggaaagcttcccgctgaagaaggagaaagctacgggctcggcactgaagacacacccgtctttgccggcatgcacgaagcggcatcactcttggtcggcggcactttaacggccgcagactgggtcatgtcaggacaagccctgcatgcggcaaaccttggcggagggcttcatcacggctttcgcgggagagcatcaggattctgcatatacaacgacagcgctgtggctattcaatatatccagaaaaaatatagcgccagagtgctttatattgatacggacgcccaccacggggacggtgtgcaatttacattttacgataatcctgacgtatgcacgctgtccattcatgaaacaggaaggtatttattccctggaaccggccagatccaagaaaaaggcagcggaaaaggatatggctattcctttaatattccgattgacgcttttacagaggatgattcttttcttgaggcttaccggacagcagcttcagaagtcgccgcgtatttcgagcccgatgtcattatcagccaaaacggcgccgatgcccattactacgacccgctgacgcatttatcagcaacaatcaatatatacgaagaaatcccccgtcttgcacacactttggctcatcaatattgcggagggaaatggattgcagtcggaggcggcggatatgatatttggcgtgtcgttccccgcgcctgggccagaatatggcttgaaatgaagggaattgacccgggatacgagataccgccggaatggattgctaaatggcaaaaacaatgccccgtggcccttccgtcgagctggagcgatccggctgatttatatcctccgattccccgcaagcctgaaatcacagaaaaaaatgcccaaactgtcagcaaagcattatatgcgatacgctctgaacagcaaagaacaaagtaaaaaacgacctttacgaagaggtcgtttttgattttttgatcactatttccacacgccgattttccttcatgtgttcatttgtcttgttatccttcaccggctttgtatccgcataaccgacagcaataaagcgcttggagggaagcttctcttttgacgtgaagtattgaatcactccacttgcccgtgctgctgatagctcccaattcgacgggtatcggtatgtcgaaatgtttcggctgtctgtatgcccctccacctgaatgtcatttggaatggtttgaagaagaacggcaatttggtgaagaagtgtttcggcatttttcagcacctttgcctcacctgtatcaaacagcacagcctcctgaagaacgagcacgacaccgcgttcatcccgtttggctgtcatttgggccttcaaatgattgtcttttatatatgtatttactttcttgagaagctgatcctgctgatcctcttgcttcttcgtatcagatggggatgtattctttttttctatggatgtttggtccggctgaagcccgttgccttccttctggatcgagtccactgcagctttgaatttttgcagatcgatttgggacatcgaaaagagtaaaataaagaacacaaggatcaaggtgatcagatctgtaaaggttaccatccagctggatgaagattgactgttttttccgcttccattccttctgtcaaaacgttctcttctaagcttcatgtacagatcccttttttgtttttacttgttttggctgcttcttccattcttcccgtgagctgaaaacgaccagctggctttcaaggttgcgcgggttttttccggattgaacaccgataatcccttccaccattacctgcttgatgaaaatttcactttctgttttctcttcaagcttagccgcgatcgggttgaagaccatatttgccagtaatgaaccatataaagtcgtcagaagcgcaatggccatgtttggtccgagcatatgcgggtcgtttaagtttttgagcatcagcacaagcccgacgagtgttccgatcattccccatgccggagcgaattctcccgctttttcaaaaactcgccgcccttttcggtgccgttcctccattgctgcgatttctgaatccatgacgagccgaatcgtttcttcatcccagccgtcaatcgctaaaagcagcccttttttcaagaatggatctttgatttcccgagcctgatcatccaatgataaaagcccgtgttttcgcgcgtgatcggaaagggaaacaaaggttttcacaagatctttcacattgtcttcctggcggatgaatgcctgctttaacacagagggcgcttttttcagctctcttggcggaaaactgataaaaacagcggcgcaaagtccccctgttacgatgaagaaagaggtcagatcaagaaaagagcggaaaccgcttactcccgatcctgaaataatcccgataacaataataatcgttcctaacacaaatccaacaggtgtaagataatcaaaacgtttcatcatttctccccatgaaaaaagcaagaattcaccataaaggtgaagcttgctctttgtttttcttatgacttggttgactttctaagctctatacggtgcggcagttcgacgatatgctcttcaaccggctctttattcatgagcttcgtcagcagtctcatcgcaacggcgccgatatcatatgtcggctgaacaactgttgaaagctgaggacgaaccatgaggcttaatcttgtattatcaaaaccgataatgtcgagatcctccggaatggataagccctgatcctgagcggcatggataatgccgagtgccatttcatcagttgcagaaagaatggctgtcggttttttatccaggctcatcagatgctgcagtgcttcgagtccggaatcatatgtgtaatccccttcagctacaaattgttcattaaacggaaggttcgcttcttcaagcgcacgtttgtagccttggagttttttcgaacggttgatcggttctgccattggtccggaaacgaacgcgatgtctgtatgtcctttatcaaccaaaagcttcacggcatcataaatcgcctgttcgtaatcgatagcgactgacggtgtttcctcctgctcttctacagaagcggcaagtacaatcggcactggagaacgcttaaattccgccacatgctcgtccgtaatgtttccgcccataaacacgatgccgtccacttgtttgccgagcattgtgtttaacaagtgcagctctttctccatgttttggtcagagttgctcaaaataatattgtatttatacattgtcgcgatatcttcaattccgcgcgcaagctctgaatagaaaatgcttgagatatcgggaatgatgacacctacagttgttgtttttttacttgccagtcctcttgccaccgcgtttggacggtaaccgagacgttcaatggcttccaagacttttttcctcgttgtcggttttacattcgggttgccgttcacgacacgggaaacggttgccatgcttacattagcttctctcgctacatcgtagatcgtaatattgctcatcctaaaaccactccttttactggatacacttatccttatctatagcataaacactttatgtagagaaatgtcataatgtccgaatttatgtcgtttatgatttgtaagcgtaagtcagtagtgtacattatttttcattattcatcaaatttaattacttctcatgaaattatacacgtttttatagatgatgaaaacgtatacttggtttttataactaaataaacgagaaagcataaaaaaaggccgcaggcgcggccttttggattgttcaattaagcgttgactttcaccattggcttcagttcattcagccatttttcgaattcaggaatcgccatttgctgagcagagtcagaaagtgcgactgacggatcagggtgaacctcagccattacgccatctgcaccaatcgctaaagcggctttagctgtcggaagcaagaggtcacggcggcctgttgaatgcgtaacatcaacaaagactggcaaatgcgtttcttgtttcaaaatcggcacagctgaaatatccagcgtgtttctcgttgctgtttcatatgttctgattccgcgctcacaaaggataatttggtcattcccttgtgacatgatgtattcagcagcattgatgaattcagagatcgttgcagcaagaccgcgcttcagaagcactggctttttcacggcgccggccgctttcagcaattcgaagttctgcatgttgcgcgctccgatttgaatgacatcaatgtagtccagcgcttcttcgatatgagccggagttacgatttcactgataaccgccagatcaaattcatccgctacacgttttaaaatttgaaggccttcaacaccaagcccttggaaatcgtatgggctcgtacgaggcttaaaggctccaccgcgcaaaattttaatcccttgttttttcgcagctgcagcgacttcagctacctgctcatagctctctactgcacatgggccgacaatgaatctttgctggccgtctccgattttttcgcctttgatatcaacaattgtatcttcaggttttttcttgcgggagacaagcagcgctttgctgtgatcttcttcctgaagctctaaaccggctttgaatatctctttaaaaatgtgctggatggttgaattttcgaacggcccgtcattgttttcaatgatattgtttaacattgtgcgttctctgacagggtcaaatcggttgacgccctgtgcttccttcgctttaccgatctcttttacaacatttccgcgttcgttgattagttttaaaatttgtaggtttaattcgtctgctttctgccttaaaagctctaactctgtgttgctcatttttttcatcctttccctgcacattcattttttattttgtagttatcatgcatcttactataagtaattccaaatggaaatactgaaatacaaaaaattttataaaaactctactttattacccaaacgcttttaagtgataaagtaatctatgaagctatcctacatgatgtgagggcaatgttcaagggttttttacaaaaaaaagcgccagatgatatctggacgcttttttctatgacaaatgctgctcaatagcggcttctgtaatttgtgaatgtgaggtatgccatttcacttcaccgttctggatgatgaatacctgagggctttcatgcttgaccccatatgtttctgcaatgaaattggacagcggccgggcttcttgtacttgaagatagtaagccggcacatcctcatgctgatttgcaaaggcatcaaactcatgaaatgctgcctggctgatcgggcatgtggtgctgtgtttaaagaagacgaaaacgccttcctgttctgcaatccgtttaaattcttcctcagattgaataagctgtttagccatgactcaagctcttccttccctgctcagcgattcaactgctcagcctgtttttgtgcatctttcagttcgtcttttacatcttctttcgtctggaggacttgatcttttgtttcatcagccgcctgcatcgcttcttccctcatatcctgcattgcagtcgatgaatccgttttgtcagatttggaacggtctctcaaatcctttaccttgttcatgatctgtccagactgatcggctacaagctgtgtgatgttggaagttttgtcttttgcgatgctgacatattgcgtgcctttttccttcgcatctgccgtcattttatcagttttgtcccgtaaggcaacagcctggctgccgagatcgtcgcgaagttctttgcctgatttaggtgctagaaaaagagctgtagtggcaccgatgattcccccgattaaagttccgattaaaaaatctttactattaattccatctttgctcatcattattcctcctcttagtatttttttctcttacagggctgattttttcttttgcttccatttctcccaaatttccattgctgcttgactccaagtgacaacttgattgatcttatcttgattttctctaactgatgccgatacagaccctgccgcttgtttcatggatgtattgaactgctgtacagaagctcccactccttgaacagcatgaacgaccgtgttcagcttttctgatttttcctgaatatcttcagccaggcggttggtcttatgtaaaagctcggctgtttcagttgtgatgcccttcatttgtccctccagcccttcaagagtggatgcgacgttttttagtgtcagctgcaatgacttcagtgttttagacaagtagatcactaatacgagaaatgcaactgcgatgagtgcaacgctcaaataaagaataataatcatctcaaacctccttgctgcaggatatactgctgtttacccgttttcttcaatcataaacatgtgtactgggctgtatacatactattctccgttatgtaagaaaatcctttaataagcttttccatcagataaataaaaagcagtgagatcactgctttttattatgccatgacgttttcgtaggctctcatatatttttggatatctcctgctcccatgaagatgagaacggctttatcatgagcttttaaaacagatgtgtcatcttcttcaatcagcttggcattatgaatttttccctggagatcgccgatcgtcagctttccggcattctcacgggctgagccgaaaatatcgcataaatacacacagtcggcgccgctcaggctttctgcaaattcgtcaaggaactgctgcgtccgtgtaaatgtatgaggctggaataccgcgacaatttcccgatcaggatacttctgtcttgccgcctcgattgtcacttttatttctgtcggatgatgggcatagtcatcaatcagcacttgatccccaagctgcttctcattgaatctgcgtttgacgcccccaaaggatttgagagcatgcttaatgatgctggaatcaatttcttcataatggcataacgcaatgaccgccaatgagtttaatacattgtggtggccgtacgcaggaatataaaacgtatcatagaacgtattgcggacaaagacatcaaaagttgtcccttccgtgctttttacgatgtttctcgcttgaaaatcattttcttcccccgtgccataatacacaaccgggacgttcgcatggattttcggcagatgctcgtcgtctccgcaggcaataatgcctttgttgacttgaagagccatctcttggaaagcgtcaaatacatcgtcaatgcttgagaagtaatcagggtgatcaaaatcaatattcgtcataatcgcgtaatctggctgatagcttaagaaatggcggcggtattcgcacgcttcaaacacaaagtattcgctgttttcatttccctggcctgttccgtctccgattaagaaagacgtcggttttgcgttttggatcacgtgagccagcagacccgtagtcgacgttttgccgtgtgcgcccgtaacggcaacactcgtgaattttttcatgtagtcgcctaaaaacttatgataacgtatcaccggaattccctcagacatcgctttttctatttcaggatgcgtgtctgggaatgcgtttccggcgatgactgtcatgccgggtttaatattctccgcgctaaaaggaagaaccgtaatatttcttttttcaagcgctgtttgcgtaaaaataaatttttcgatatccgatccttggacagtatatccattatcatgaagtatttgggcaagcggactcataccggtcccttttattccaacaaaatgataaacagtcataattgtacctccaacaaacgtctatctgttccccagtatatgacgctcatttcaatttgcgaccgcggcggctgaaaagcctcccttagcggcgtattttatatgttttgttatgtttagtatcaggttatttctttccgattaaacccagatatcaagatttgtctatgcacagctgctgtaaagcggcatagctgttaaatgctctaaacactatcataccatgtttggtgtgaaaatgaacccatattattcgtttattaaatcacttgctgtgatcagcacctcccgaggcttgcttccttttgcctcagagatcatgccttccgcttccatcatgtcgatcagccttgccgcacgattgtaaccgattctgaatcttctttgcaggcttgaagtgctcgcactgttttgctctacaacaaactcacacgcttcgtaaaacagttcgtcctcttctttcagggcagatccttgtcttacgagctcttcttgttcaaataaataggtcggcggcatttggcttctgacgtgggaaacgacgcggtcgatttcccggtctgacacaaagttaccttgcagacgaaccggttttcccgatccgttttccaaaaagagcatatccccttttccgagaagcttttctgcaccggctatgtcgataattgttcgggaatcaacctggcttgaaacagaaaaggcgattctcgttgggatattcgccttaatcagacctgtaatgacatcgactgacggacgctgagttgcgacgagaagatggataccgcacgctctggctttttgggcgatccgcgcaatgctttcttccacatcgtttggagccaccatcatcaaatctgcaagctcatcaataatgacaactaaatatggcagcttttcacccatttggtgttcagcggttaattgattaaagcggtcaatatcgcggacacctgaatgggcaaaaagctcatagcggcgctccatttcctcaacgacccatttcaaagcagctgtagccgctttggcgtcagtaatgaccgggctgacgaggtgaggaattttattgtaaggggccagctctaccattttcggatcaatcagcagcacctttacctcactcgggtcagctttataaagcaggctgactaatattgtattgatgcatacgctttttccggagcctgtagcaccggcaatcaagccatgcggcattttcttcaagtcgataacaacaggatttcctgaaatatctaatcccagcgcagctgtgagcggtgacttgcttgtcctgaaagctgagctgcgaatcatttggcgcaaatcaaccaccttgctcgtgcggttcggcacttcaattccgatcgtgtttttccccggaatcggcgcttcaatccgaatatctctcgctgagagactgagtttaatatcatcggacaagttggtgattttattcacctttacacctggttcaggatgcacttcaaatctcgtgacagacggaccctgggttacatggaccacattggcgcggacattgaagtttttcaaggttaaatcaagaagctgacgctgttcttcgatccacgcagtatcatcttgaacctgcgctggcgggacatcaagcagtgcaacattcggaaatacatagctgccgcggcgctcctctgctttttgctgtttatgcgtatctcttttcagcatcatcacattaaaaggaacggatggccctttttgagaagatgcgctttgttcagtccttttctcctgtacaccaggcctttttttcggctcttctgaagcttcgcgaggtttgtctgcgcgaattccctgccggttttcaagagttgcagtaaacgatttggaaccctgctccatgtgttcagttttctcaagctctgtatggctgtctggctgaacatctatcttcgtttcctgagcctctcccaggatgtcataatgattatttattatgctgtctgatggctcttctgattcttttgccacagtttctgcttgagccagagcctctgatgaatactcatgatcagtaaataaaggctcttcctgacgaatgtccatttgttcttcttgaacgaacggggactcagcaccttcttccgcgttttcatgatgattgtatactgggctgtctgacggctcttttgctttttcatcctcagatattgcctctgtctgagattcaggagctgtttgctcttcatcaagttcagcggagaaaacaggctcttcaaatttctctggctgctgctccctttgttcttcctcagccgttgcaggctcttcgcggcctacttcactgtctgaaagcccttcagccgccgtatctgtgagcatctcaggcggtgtttgctcttcggcatgttcagctgggaaggaaggctcctcttcttccggctgttgaacgcctgactcaaatggcactttgttacctgacggctcggctggccttttcgccagcgcctcatcattctccgtatcctttctgtttaaaacgccagaaggctgtttttcaaattgggtatccgggaagaaaggactttcttttttggaatgcgcctgtgtgtctgaagcaggatagccgcgttcacgttcgatctcttctgacagcagtgttaccttctcttttaccgatttatccggttcgttcaatgtttcagaaggctttttcggcacatcctttttaacagatggtttttgattgaatccatagacaggcgaagggatatttgtcggtttaaacggtttcttcgccggctctgctgcttgatatgtatgctgctcttcttcatttctgggacgctctctgtaaggtgcagcacttggacgaggcgcggatttcggttcgtccgatggtgtgcggcgccttctcaggtcatgatttttgtatccgtcaggcacgactggaaaacggaatttgccttttggatattcataatatattttaggatcttccaatctttttaattgtccttcaggatgatgtacttcttgttgctgcggaatttgagcgggttttgtctcccgttcagcatcctcttcgctttcgcctaaaaacaaatcaaaaaatttatgaagccaactcataatttatctctaactcccttatagttttctgggacggtttttagtataccactgctggtcggcccagaaaagattaagctatcagcagaaacaaagccgctaaacaagggcttagcggcttttcacatgattcgttttttttggcggatttatgggagtctaaaaccgaaatgcgtctcctgcctcatagtctccttctaacacaaggattcctttttcagcaggggcatccggcaaatcaagctctttcgctgagcagatcatcccgcttgacggaacgccgcgaagctctgcatccttaatgacaagtccgctaggcatcacagcaccgactttggcaacgacaactttttggccttggtcaacgttaggcgcgccgcagacgatctgaagcgtttcttctcctacgttgactttacatacgcttaatttatccgcattcggatgtttttcttttgattctacataccccacaacaaacttcggagataaatcaacgactaatgtttcttcaacgccgtttctgtttaaaatctcattcacatcttgcacgaatgtttctgagagcgcaacagggccgttttcatcaatagtcaagtaagaagacgcgttgaaaatgttgaagcccgttgtttcttttgtttcgttattgaaaattttgacgacgtcgccgtgtttttcatagcctaattgttcgcgtgtcacatcttgaagagagatcaggagcgtgtctcccacaccttctttattataaaaagcgttcataagtaaaaatcctttctaatcctttttcggacggcttttcgccaggataaacaccggttccagctttccttcattgtacaaaaatgaaagggcggtaatcgggacggtgccgcctgcaaagaagctcatcgacatttgtcctagaatatcataccccgattcattccggatgtcagcaagaatcaaaacgtcctgatgaggaacagagatcgccagctccccttctgcatgctgcttatactcatttaagatcgcttcgttcaaaatccggcttgcgtcgtatccgtcgtttgccctgaagaaataaaagtaattgccggcaaccgtatcttctttgacaaccgtcggcagggaacggagattaaatgcggccgtctctctgatccgctcttttgtccagttttctttctcaagcatgcgctggtcaattaaacggtaggttttcccgagatcaagcgcgtaataaattcttgtctctgcggtatgatcgtcataaatgagcgggatatcttcactggacttgtccgggaaggaagtcgagcggatgaccggataaatgcgagtttctttcccggtcatttcctgagccttcccttccattgccgtcatcgcttcagagacatagtacacgatctcatcaatggcttcgtcttttttcagttcccattttgcaataatcggcggcaaatcgagtgtaatcccttttttagtcgtttgatcctcaacacggagggtgtctttttctctgtcaaacagaaaggagcgattctcgtgctgaaggcgctgtttcagtatatctgacagcttccttgaggtcattttcaaaccgatgtcctcctttacgctttagcgagagagtctgttaaaaactgttcaatttcttcttttgttttgcggtctttgctcacaaaacgatttacttcttttccttcattaaacaccacaaagcttgggattccgtaaatttcccactctgcacatgtatcaatgaatttgtcacggtctacgtagtagtaggtgaattcagggaaattcgcttccaattcaggcaggaaaggctctacaaaacggcaatccgggcaccaatcggctgaaaacataaatacagaccaatcatcctttaccgctttttccagctcttgagttgattcaatttttttcatttcatatccctccagttgtttatgttcttacatgttttttatcgatactcgtccatttggatcataccaaactgcttgaggcaaaaccacttatatgcaacgaatgaatatgtaagattggctttcccattatcattatcatattttatttgcattatcaagctcgtttcgtttaacatcgtgtacatgagggtaaaatttacagatggacatacataaggagggatttttatatggagtttatcgtctatttagcaggagaaatccacagcaattggcgcgaggaaattaaagaaaaaacaaaatcactgaagctccctattacgtttgttggcccgatggagaatcatgaccgctcagacaatattggtgaagaaattatgggcgtacagccaaatgccgttttaaaggatgacaaagcctctgacatcaacaacttcagaaccgccgtcctgatgaataaagcagactttgtgatcgccctgtttggcgaaaagtacaaacagtggaacacggcaatggatgcatcatatgcgatcgcaaaaggaaaacccctgattatcatccggccagaatcgctccaccatcctttaaaagagctttccaataaagcgaatattacggttgaaaccgttaaccaagctattaaggccctttcctatctatttgaaacagaataagaaaaaagcttgtcgatccgggcttactgctcgttcaacaagcttttatgaaacctacatattttctttaatcgcatccaccgtctgcttatcgcaggctgttacaagtttgatgagcatttctttagcagcagcataatcatcaatatgaatgatagaagcgtttgtatgaatatagcgggaacatattccgataaccgctgacggcacaccgctgttcgaaatatgaaccttgcctgcgtctgttcccccgccggatacaaaatattgatatggaatatcatgcgtttcagccatatcaagaacgaattccctcattccgcgatgcatgactgtcgttctgtcaagaatgcgcagcaaaaagccttttccaagctggccgaattcatttttgtctccgctcatatcgtttgccgggctggcgtcaagggcgaaaaacaagtccggtttaatcatatgagaagccgtctgcgcgccccttagccctacttcttcctgaaccgttgcacccgcatagagtgtattcggaagctctttaccgtgtaattccttcagaagttcaatgcttaagccgcatccatatctgttatcccatgcttttgataaaattttcttttcattcgccatcgtcgtaaacggacaaacaggcacgatctgctgtcccggtttaatgccgattttgatggcgtcttccttatcatccgctccaatgtcgatcatcatgttcttgatatccatcggacggtttcgctgcgcatctgtcaataaatgcggcggtatgcttgaaatcacacccggaaccggcccgttatctgtttgaatttcaacccgctgcgcaagcaaaacctggctccaccagcctccgagcgtctggaatctgagcagcccgttgtctgtaatggatgtcaccatgaagccgacttcgtccatgtgcccggctaccataattctcggtgcgtcctctgcgcctcgtctgactccgaaaacacttcccagtctgtcctgaacgatgtcatcggcatatttggctagctcctgcttcataaaagcacgaacctgatgctcattgcccggcgcgccgggaagctgcgtcagtgtttggaaaagcgctttcgtttcttgattcatgttttcccctcatttctatgtagtccttttattttattagaaacaatgaagttttccaagcaccctgacccaatctgctcgatcagccgcgtattgcttaacaggatttggctgtttctgtataatgaaaagtacgatcaaccaggaggtgctttattttgaaattgcgtcatcttcttttaggagcaggacttggaatttgtacggctgtcgttgtgaaacaatatgtgatgaagccttatatttcttcagaaaaagcgcttcgaattgtaaagtctgcttttaagcagcggggcccgattgacggatcatggatttacacccagccggagccttacaatattaacggagaaacggtacaggtatacaaaaccggcattacacgatcagctttcggagaattagaacagtatgaagtcatggtggatgcgaaaacgggagaaattgttgatgtcattgatacaatcgcctcttaacaccggacaagcaaaaaatagaagccgctgcctacgcagcggctcttttttattatatcgcgcgaatcggtttgtataccggataccacatcgcatcctgcactgcctgtataatgtcttcaggctcttccgtagcgacgccttccttcattgcggtttttgcaacttcaacagcaacggttgccgaaacagtgcgcaaatcttcaacttttggaagcatcggcgcgccaggcaccccgacattgaccatacctgcgattgcccgggcacatgcttcaaacatgccgtcggtaattaattttgatttggtaacaatcgttccaagaccgagaccagggaagacaagcgcgttgtttgcctgcccgatatgatacgtaactccgttatattcaactggcgggaacgggcttcctgtcgtgatcagcgcacggccttctgtccattcgattaaatcctccggttttgcttcagaaagagttgtcggatttgacattggcaaaatcgccggccgtttcacatgtgacgccatttcttttacaatttcttcagtgaaagcgccggaaaccgtagatgtgccgatcaggatcgtgggtttcgcctgccggaccacttcaagaagatcaatgcctccgccgtctccgttccgctgataatccttcacttcttcagccgaacgagcatacggcttttggaaatcaagaagctgatccatatcatctgttaacagcccgtttctgtctatgcaccagaagcgcttgtatgattcttcttcactcagtccctcgcgcaccaatgcttcccgcagctgttcggcaattccgattcctgccgttcccgctccgaatataacaactctgtgatccctcagcggaactttagacgcttttgcacaggataagactgcggccaaagaaacagcgccagttccttggatatcatcattgaaggtacacactttatctttatagcgtttcaaaatgcttcgcgcgtttttcgccccgaaatcctcccaatgcagcaatgcattcggaaatgtttctctcgccagcgcaacgtagtcgtcaataaattggtcatagcgttcgccgcgcactctggaatgctggttgccgacataaagcgggtcgttcaagaggctctcctgatttgtccccgcatctaaaacaactgccagcactctgctcggatcaatgcccgcagccgctgtataaaccgccagcttgccaatagaaatcgcgattcctccgacgccccagtcaccgattcctaaaattccttccgcatcagtggcaacaattaaatcgatcgtatcgctttgatctttatactgtttaaatgcttctttcataccgtccgggtcatcgattgacagatagagccctcgtggttttctgtattcatggctgtatctctggattgccgttccaactgtcggtgtatagacaatcgggagcatttcccctaaatggtcatttaacaggcggtaaaacagcgtttcattccgatcgtgcagcgccgttaaatagacatttttgctcaaatcgtcaggctgtgcggaatattgttcatacgctcttttcgcctgatcatcaattgttaataccttgggcggcagaaagccttttaaaccaagttcttttctttcttcctcagtaaaagcaacacctttgttcaaaaaaggaacagagagcacttcaaggcctcttaatgttgtttgaatgtctccttcgtttgttactctgaattgtttcaccctgcctcttcctttctgagcataattagtactaggtttgcattattagccggaaaacatgcagggtaaacataaaaatatgctatcgcttcattcgcttaactgactttttgatacttccgtcctcctcccattgaagggcgcgatactcggcatcatggtaaaaaataaaccaagcatctttttctgctgcgaacgcctgccatttctgcttttgcgggatagaggtcatcggataatcatcgtaagccagcacccatagcggattgcggtgggcatgtgtcggcatcagatctgccatatgtacggcagtttcacccgcatcctcgcatatcaggacactgtgtccgtcgctatggcctccggtgtgatgcattgtaataccctctgtgatcgttaaggtgtcttcaaaggttttgacttggccagctacagcctcccaattttctttccaatacgtatttttcgacctgatattcggatggcgcatttcgtcccattcaacagctgatgtataaatcactgcattcggaaagacagagacgagccgttcaccttcatattccgttaaaccgcatgcatgatcaaaatgaaggtgtgtcattgcgatcacatctatatcggcaaccgttaatccgagtgcagctaatgagggtttcacattcgactcttgtgtcacgccatagtttcgtttttgtttatcagtcagcttgccgtacccaattccggcgtcaacgatgatattgagcccatccttttgaatcaaaatagggtctgtccttagttcaatctggtttttttcattgactggatattttttagaccaaagcggctttggaacgacgccgaacatggcacctccgtccatatgcgtcacgcccccgtcaagccaggtcaacgtgatattaccaattttcattgtttccattttcatcccccctgtcatcatggtagcaaacggcccataaaaaaaacagactcctgtcagagtctgtctttacgttctccattcaacctcagcccgatagatcggctggccgagtgcagagaatttttcttcatattctgtcataatattgccttccagattgctgttatgcaaatcgaggctgacgtatgtcagcagcaggccgtactcagagaagctcttcaaagagtactcaaataaacctcggttgtccgttttaaaatgaatcgatccgcctttgcccattacttcttcatattttttgaggaagtgggaatatgtcaagcggcgtttttcatgccgtttcttcggccaaggatcagaaaagttcaagtagacccgtttcacttcccccggctcaaacacatccgtcagcgtgtccgcatctatattcagaagctttacattctgcgcttcgctgtcttttactttttggacggctgtcacgatgacgcttttaaataactcaataccaatataattgatgtcgggattttgtttggccataccagaaataaattggccttttcctgtaccaacctcgatatggatcggattgtcgttgccaaacactgtgttccatttccctttataatcagcaggattgctgatggcaatatctgcgttttcagccaaaaagtcatcagcccaaggcttgtggcgcattctcatatgattgacacctctatctattatttcgactaacaacataccatgaattaaaaagacccgcaagctcgtttttccagtgtatctctcttaaggccgagcgcataaaaaaagagggtcccgtctgctggaacactcctttcacatgtataaaaacgctctgttttgaacaatttaacccgtatgatactgaagggatgtgtaccgttatgggtttacattatgagcatcaagttcatttattgaaggatatcttgactgaccatcaattggactgctgcggaacagtcgcagagtacgagcagcttgagcgtgtgattaaatcactgatggcaaacaccgagcttgattcaaatttcaaaaacgtgcttgaagatgtttaccgctacagccaatcaggaatatcgtccaaatccattgactcacacatacaagagcatcagaacagcctgtctcaatgggtagagcaaatggattcgtattcctgattaatcaacaattcgtttcatgaggatatgcagctcttccattgcatcatgaaattccttatcattgccttttgctttatgccaggcaatgaaagtaattgtttcagataacacataccaagccattcgcaaccgaaggctttctgtcagctctatgccgtacatgctcagccagctctcccaagctggcttttcgacgtagtggtacagcaaaggcccgaggtccatcgccggatcagcgatcatggcgccgtcccagtcaattaaatacagctggttgtcttcagacaatagccagttattatgattgacatcacaatggcaaacgactttctcaccgaaatgcacttcatgcaggtgttcttccaaatacttgatcccttcttgaatcagcggcgaagattgctgcacagcaaatacagcctgcttcagctgagacaaaagagcccccgggttcagcggttcttttccaagtctcttcagcatgtccagcaaggcttttgatgtgtgtattttacgaagcaattcagcaacgggccgtccgctcatgtctttaggcttcagctctctgccggtcatccagtgctgggccgtaatgacgtccccattttccatccgttttgtccaaaccagcttcggaacaatgccttcggcggataaaacagctaaaaaaggtgagctattacgttttaaaaaaagctgctgcccgttatgtttcgcataatatgcatctcctgtagctcctccggcggggaagatctcccaatcgctacctagtaattgtcccaaccagttcatatcaatgttcaacccatcatttcttaaaatattttagaattaaggctaatcgtttctagtctatccagcgaatgcctttttcgtacgaatcgtataaaaataaaaaagacagctattgagagtctcatatgctaatcaatagccgtcctttaaattttagcgctatagcacaaacttcgtcaagcaaaactcttaagatctgatgctaaatataagataaccgttccgatgccgtttactgcaaccgttttcttgatttctgccgggtcttcctgaaatcctgatggatcacataaaagccgataaggtatgtcgtttggcagcctccactcgacggagtctggactcgcgtgatggataacaatgatatctttccattcgtcaacctcgtcaagatcataaagcctgtatgcgataaggtgttcttttagcgtcaagcattcaagatggcgccggatgtctgcagcggacctaagacggaatgcaggatgcgcttttctcagcgagatcagcctgcggatatagtgaacatcttctttgaatgtttcgcggcgatcccagtcgagctggttgatgctgtcactggattgatagctgttttccactccctgcttcgtccggaaaaattcctgaccgctgtgaataaacggcaccccttgggcaagcaaaataatcgcggctgcaagcctttgcctgcttcgctttcggctgtcattttcttgaggaagcgcgaagctcattttatcccaaaaggtgtgattgtcgtgtgattcgacataattgatggactggcttggttccggaacaatcggtgctaatgccttccatccggaagacccggcaattccatgcatcacagcttgtgctgattcactgctgccgagcgcaaaccctgctgccttaaggtgaaaggtgttcccttttacagcgtcacgaaacatatcattaaaaaagccgatgcccggcattcttggcgcgttcgccaaagcagctttctgttcatgcggcagcggtgtagccagatcccacccttctccaaaaagcaggattccgggctttgccttagttgctttctctttcatataaagcacggtgtcaatatctaaaatcccgaggagatcaaagcggaagccgtcaacgttgtattcttcaagccaatagaccacgcaatccgcaatgaactttcttgccatccttctttctgatgcgatatcattgccaacgccggtgccgtttgatggcatcccacattcgtcgtgccggaaaaaataacctggcactgtcttttcaaagggggaattctccctcttatacacatggttaaaaacaacatccagaatgactcgcagaccgtgctgatgcagggtattgatcatttgtttcagctctgtttttctcgtttgaggatcatgagggtttgaggcatagcttccctccggggcaaagaaatgaagcgggttatatccccaattgtatgcatcaagcggcttctcttcatcaactccggcaaaatcgttcaccggctgcaactctacatgagtaacaccgagctcttttatatacgccagtcccgaagaactgccgtttgcggtttgtgtatccgtttccgtcagcgctaagtattttcccttgtttatcatgccgctgttttcatggatggagaagtcgcgaaggtgcgtctcatagatgacggcatccacagggtgtgagaatggtttaagaggagcagtccatttcatttgatccgggcgcaagacgacgcccttctctccatttacagtcacagccttggcatacgggtcaactgtttccatccattctaaattgttgcagatgcaaaacaaatactcatacccgtgaaggtcacccgtgaccgtaacagcatagacacccttttccaagcgattcatttggaatgtgcgcccgcttttattggggtgtgaaagcttgacagcagctgaggttgcagcaggcgcccatactttaaatacggtatgatccgcggtataaacggcgcccagctctccgtcataataaaattcgtcatcaaacgcagccgtccggatgaccgcgccaatttggagatccgttttgtggccgctggatgctctgacgcaatggatttttccaaatgtcacaggatggtcggatacgcagacgtacttgtattttgcttcaagggagtattcctccctgacagccagaggaaaaactgttgtttctgtctcaagccgaaacggcggtgtcatgatttccttttgttcagcaggaatcagaacagtaatgatattcatatcatcgacatacgcttcgaagctgcggcggatgctgaccatcggaagctctctcctccaaacacgtttatgttttgatccttaggggtgaaggactagatgccagacgaaacggggtagtgcccatgatttctccgtcagcatggaacgggattttgtccttcgtgtaaaatgtaatgtccttcgctttaaacatcgtaacgccatccatctttgtatgttttccaaatgccatgagacataaaagccaatattttttcaaaaacggctggttttcaacgattacgatatcaaatgtcttctcgcgcggatttgctaggggcgccgccttcatgcctcccccgtaaaacggatggttggatacaacggcaaaccagacatcatgaaattcgcgcgtctcgtcttccgtcgtacaagctaacgtaaacggcttaaaggttgccgaagcgtgcaaatgagaaagcggatacacaagaaatcgaaggcggagaaaaagaaaaacccgtctcaacggaaattccatcgcctttttattgacatatgcgtcaaacccgatcccgatgtgattcataaaataaagaatctgtgatttatcctgaaggaaattgacgctccctaaatgaaaggttcttgttaacgggcgctttaccttcttgatttcctgtatcagatcgatttttttaatagagaaccctcgcgaaaaatcattatacgcgcccgccggcacaaagctcagctcaatatcgtcaacatctttcagcccgttgacaacttcatgcatggttccgtctccgccaatgacgatcaggcgcttcagcttatattcctgtatcgttgaaatctgtctggcgagcacctcggcgtgtcccggatgttcagttaaaaatgaacggtgctcaacctttcgtttgatcaattctttttgaatggacttccaaacacgcaggccgtttcgatgtcctgctgtcggattaataataaaaaaccaatggctcatctttctcacctgcttatgttatgagaaaaccgctcaaatcgttctcttttactccagccactcctgtctgcgataggagtcagacatgcagtaagacaatagagcctttgcagcctttacctgatgatgtttgatcggagcagtgtttttcttctgccgctcaatccattcttccgcgctccgcttatccgctatttctaagccgtatggcggctccgggtaatcgatgtacgacgttctgctcagaagcaattttcgaaccggaatctcagcctgtttttcctttacgatctttgacacaaccgagtccgtacgaaacaggctaagccctggatttaacactgatgcagtctgagaggctgttttcttgtcccaaaaacgatttttagaccctatgtagacactgtcttcctcagcctctaaaaaagaaacgcaataaatttccagaggagaaataatcacaatgcttaattcaaccgccgcctgctgaattttcagcacaggcttatacataataaaataagaatcaggcagctgctgggtcagataacgcaaaatgcggtcctgcttcacttggtttgagagttgagatatttctgaaagagtagagcttgcccatttgagctgaaaatcatataaatgccttttataaaaagaagcaagcgccaccctgctcttcgggagccttacatgaatatcttcttcgtcctcaaaccattggtgtctctcttcttgtatatcggcttttatctcttcttttcttcttttcaatgaaaatttttttcgtttctgcaccggttccggttcttcagcactggcttgcctttcttcatgctggcgctccgctgcttctactagtgaaagccagcgctcttttttcaaacgtacaaactggttgatataatggtacggatcaagctcatatctcgatatataatcatgaattttgatgatttgtgccatgtttgtttctccactccgcaatgaattaagataattgaaatttgaatatttcctcgtattttggtgattggttcaagtgtatttgaaagagcgaaaatcgttcagccatcatcgaaacctcgccgctttcaaacggaacatgagctggaaatccattttcgcctgtccattttcttgccagcgtcatatgaggatgatacggtcttttttccacttgaaagccggcctgaaggacagcctgcttcgtatgttcccgcagtctatcaagcgttttgtttttctttggctccagatgtaaaacgcgcggccttctgcggtcgccgaatacatctatcttgtcaaactcaattgaaaatgggtcaatttctgaagcaatctctgctagcgaaccttcaagcttctttatttgtgtctcatccgccgctccgagaaaaattaacgtgatatgatagtcaagcgggtgcacccatttttgaaacgtcaataccggttcgtttttcgcagcctggtagatcggatttgcaattccctcaggtatgggaacgccgatgaaataatgaggccgtatatctggcatccgtctgacactcccttctttgacagctattattttatcaataaagaggctgtgcggatagaggaacagtgtatgaaaacactctcgcacaaacgtttattatgttaggatattatatgacacttgttttattcagaaaggaatgacaatgttgaaaatcgttgcaaacacagctgatctgataggagatacaccgctagtgagattgaatcggcttcagccggaaaatgcggcacaagtctatttaaagcttgaatttttcaatccgagcggcagtgtgaaagacagagccgcttatcaaatgatcatagaagctgaacaaaacggtttactcaagccgggatcagttattatagagccgacaagcggaaataccggcatcgggctcgccatgaatgcggcagcacgcggatataaagcaatcttagtgatgcctgatacgatgacgaaggaacggatcaacctgcttaaagcttacggcgcagaggttgtattaactcccggagaggaaagaatgccgggcagcatcaaaaaagcgaaggagcttgccgaacaaattccgaacagctatattccaatgcagttcgataacactgccaatcctgatgcgcaccggaaaacaacagcgcctgaaatcgcccgggcaatagaggaaatcggaaaaccgctcggcgcttttgtcgcctcctctggaacgggcggaaccattaccggaacaggtgaggcgctcaaagagctttttccggatatcacggttcatgttgttgagccagcgggttcgcctgtattatccggcggaaaacctggcgcgcataaacttgtaggaacgagcccaggctttataccgccgattttaaatgaggacgtttatgatgaaattatcaaaatctctgatgaagacgcgtatacgacgacaagacggcttgctgctgaagaaggaattcttgtcggtccttcatcaggcgctgcctgcttcgcggcaatcgaaacagcgaaacgcctctctcctgacaaagttgtggtctgcatgacagctgatacaggagaacggtacttatcaactgatttatggtcatttatttaaaaaaaggactggcttcagcagaagccggtccttttattttgcaagctcgtaaatggcctgagcatataacgctgtcgatctcagcaggtcatcaatttcgatatattcatccttttggtgtgcgctgtcagggcgtccggggaacagcgggccgaacgcgacaccggcttttaaggatctcgcatatgtccccccgccgattgagattaagtcagcttttttacccagctggccttcataaaccttttgcagggttttgactaacggatgatctgcggacacgtgatgcggcttgctgtctttgaattctcccagatcaaattcagatgcactttcgaatgcatcgcgaatcgctttgctttctgctgtcacaggatagcggatattgatcccgagctcgcctccttgcccttctttatagcgcagtgtgccgacatttaatgtcagctcaccgctgatttcatcctcacagtcgatgtccagtttttttcctcttgtatcacctgagaacttatctgtcacaacttgcacaaaccgctttcctgcatcgtcaagctcagtctgctggagaaattcgcacaataaaatgccggcattgatcccattgttcggttccatcgcatggcaggaaagaccgtacatacgcaaaatgagctgaccgttctctattgcagcttcccctttttggtccgtcgtgcggagcatgtctttaaatgaagacagaatctcttcttttttcggcccttcaatgacagcttccgcagcgtcgggcaccatgtttaagcgaaggcctgattgaaacgagacaagcactgcctttggttctgcttgatttgggcggtgcggtataagtaaagaagcatcgatgatccctttttccgcattaatgattggaaaatcggcgtcaggcgcaaagcccattgttggcatttcttcatgcttgaaataatgctctacgcatctccaatcactttcttcatctgttccgataatcattctgactcgcttggacaggggcaaattcatgtctttcacgattttcagcgcgtagaatgccgccattgtcgggcctttgtcatcaatggcgccccttgcataaatccgtccgttgcggatttcagctgaaaatggatcactcgtccatccatctcccggcggcacgacgtcaacatggcaaagtacgccgataatgtcatcgccctccccccattcaatatgacctgcgaagccgtcaagattttttgttgtaaagccttctttttctccaagctccagcaatgaagtcaggctggcatttaccccttctccaaacggtttaccgggtccggcggttgtttcgtccatgacactgttgattctcaaaaattcctgcgtatcacgaattaaatcctctttttttctgatcacttcaacttcccagttcataatgatcccctttccgcaagaaatgacttgcaaaaaccaaataaaacgaataatattaatggtgttttgttaaaacgttcgtaattggaggatactatgtttcatctaaaagagcagcaaacatccataaagcaagaaatcatagcagggctgacgacctttttcacaatggtctatatcgtcgtggtcaatccggtcattctggctaacgccggggttcctttcgaccaggtgttcaccgcaacgattattgcctccattgtcggaacgctgtggatggccctggcagcaaattatccgattgctattgcgcccggcatgggcttgaacgcttatttagcctttcatgtggtaagcgcaagcgatggcggcatcacgtacgcaacagctttcagcgcagtatttacagcaggggttctcttcattattctatcgttaacgcctttaagaaaacaacttatagaagcgattccaaacaatttaaaatacggaatcacaactgggatcgggctgtttattgcttttatcggtttgcgtcaagcgggcattgtggcagctgatgagtcaaacctggtcactctcggcaatctgcattcacctggtgttattttaacgctggtcggccttttgatcagcgtggtcctgatggtgctgaatgtaagcggcgctttatttatcggaatggcagctaccgctttgatcgcctttttcaccggtcagctccattttccaaagggatttatgtcgcttcctcatttgccggaaggattgatgatctcaaatccatttatcgcttttggcgatgtcattcatcacggcctgtacgctgtcgtcttttcttttctattagtcaccatttttgatacgacaggcacgatgatcggagttgccgagcaagccgggctgatgaaaaacaacaagctgccaaacgtgcgaaaagcgctgcttgctgattcaaccgcgacaacagtaggagctgttttcggcacaagtccaacgactgcatttatcgagtcttccgccggtgtcgcagctggaggaagaacggggcttacggctttgactgtcgcggtgatgtttgcggcttcaatgtttttcagtccgcttgtcagcgccttgtccggtatagccgccatcacctcgcctgctttgattatcgtcggcagcctgatgatgggttcagtttccaatatgaactggaaagagatggacgaggcatttccagcgtttctcgtcattctggccatgcctttgacatccagcatttctacaggaattgcgcttggctttatttcatatccgatcgtaaaagcggcgcggggaaaatggagagagattcatccgctcgtcatcgttttcgccattctgtttttcatccagctgtttattttataacatagaccaaaaaacccaaacgtcgccgtttgggttttttatgtaaacaataaagagacagcggccgctaaaaaacaacaggcggcaaacgcatagtgcaggatattgatacagctttttctggcccgataatattcatcactttccttatcggcgccaattaaaaaaggggcatccatgaccttgtcaaaaataagcgtcaggatataacggcaaacccctgtgtatactagcagcgcaatcaccttcagccaaattggggaaacaaatatgagaacagtgaaagctgacaatagcatgtacatctgcctcgcatactcgccattcctcagcatgactttaaaaaacaattccttatagcctgtgcagatcgttcgtcttttaaatatcctttttgaattacggtataataacggttttcttctcatcctgtcttttacttttggcattcccgcctcctgactcatcatcatcacaagtcctgcaagagcaagcctgctttttttctcttcagtcacctcagcttcaaaagccgtgaacgaagccgtctttttcaaactgcggataactgagaaaagcaaaaataaaatgccaaaaagcgcaagcaagtgccactgagtcaaaacaatcaggatagcagaaccagcaaaaaatatagctctgacaaaaatatcgccaatccatctcgaaatggagcgcggctttctgatcctgtcttgctttaaggataaaaagaatatatgaaggccaaacaaataagacaatagagcagtgctttctgcgaatgtgatgtgaacagaatgactgataaggggaaggacaataaaaaagagaagcagccatttagccagcgtgaccagaaaagaatacaaaagcgcgtaccgtttgagctgatagatgatttccttcttttgcagcaaaaacactttgtccgcttccattaaaaatgtacgaatcgagcctgtaaacatgatcagcccacacacagcgtacagccatctccactccgccacttcagaccactcataaagaaggcctcttccattcatcaaatcaatatactgatagatgacaaaagcaatcgccggcaaaacgatgtagagagcgactgtccagtcaatgaccgcatgcaacactttaaactgatacttgtaatagtcaaacagccttcgaaaaaagagcgtacgcccgttcatggccgatcaccttgaactgccttataaaaacagtcaagcaatgactgcccctctaatccggtcttgtcctgaatatcttttaacgtgccttggagaaataatgaacctttctcaatcatataaaaccggtcacagattttttccgcggtatcgagtacatgcgtgcacataagaattccggctccacgttctttttcagccttaagcatgtccacaaagcgtttcgtcgatatcggatcaaggccgataaacggttcatcaatcacatacatatccggcttagagagaaaggcctggataagcattagtttttgctgcatgcccttcgaaaaggtgacaggcagctcatgtttgacatgatcaagcgaaaacgtctgcagcaggctttgggcccgatgcgcaaattctctctcttcaatgccgtggagtgtgctgatcagatccaaatgctcccacagcgtcagttcttcgtaaaaggacggatgctccggaatatatgcaaatgaacagtcgttccaggcaatatgccctttaaaatcttctgaaaggccgagtatcgccttgattgcggtgctttttccggcgccgttagctccgatcagtccaaccagctccccttttctgacttccagaaaaacatcggtgagcactttttttcggcttgtatacccggcctgttctattgaagcttcaagcaaatttgtcaaaactcacccacctccaaaatttactacgaaacagaataaaaaaagtttctttaaccataataatattgagccgaaatacatagtaatccaacaaggatggctgcccaacgcgaattggaaaaaattaataggagttatccctagattcatcactgcaatatcgtgtataatgagggcgaattattttaacagttacagatgtctgcctttgttgctatttcgtacgcagttgatagtcgtgagttgtggttagtcaagtccatccgatcttatgatagggagtggttttttgaaaccttcaacaaaccgtatgctaactcgaatcaaatcagtttacatgtttatccaagaaaaaggtcttgtgacaacacaggaactggttgacgaattcggcattacacctagaacgattcaaagagacttaaatgtgttggcatataatgatcttgttcatagtccaagccgtggcaagtgggagacaacgagaaagaaagtaaagattacctcataaattgaaaaattacatagggccgcctgagagcggtccgatagataatagggcgaagaaactactgagccttgtttttgtgtgcttataaataaaaccccgcattcggtatgcggggtttttgtcatgcttgcggctcattgagcaaatgaagctcttcctctgtcagctcacggtattctccgggtgccagagcgggatctagggaaacgcgtcccatcgaaagccgcttcagataaaccacttcattgccgacagcctttgccatttgcttgacctgatggtattttccttctgtaattgtcaggtatatcacggtattgccactgtcgtttgttttgatttccgcttttgccagctttgttttatagccgccctctatgtagacacccgtttccaaatcggagatgtcttcccgagaaatctgtgattttaaatggacttcatacgtttttggaacatgctttttaggagaaaggagccgatgtgcgagctgcccgtcatttgtgagcagcaaaaagccctctgtatctttatcaagcctgccggctggaaatggctcaaatctcatctcctccggcgtcagcagatcgaccactgtttgctgccggctgtcctcagtcgccgacagcacgccctgcggtttattcatcataagataaatgaactctcgataatcaaccggttccccgtatacggtcacctcctgcgtatcaggatcaacgtgcgcctttacatctttggcaggtttgccgtcgatcatcacggctccagccttcacaacggctttgacttcttttctggaaccatacccgctgttggcaagcagcttatcaagtctcattcccaatctctcctttataaaagaaagcccgcagcatgcgagccctcagtttcatcatatctagttcatcagcctgcatgtctgcctttctttaagaaacctggcaaacggcggcctaaaattttctgtaaaaatcctaatcggtagccacaatacaggtagacagctccgccaacagcggccgcgatcaccacaacaatcgcagcttgcagctggccatcctgataggaaataaagaagcctaatacccactgcacgattttcacggcaatacccataatggctgataagacaagcatcaaaacagttcgtttaactagtatcttatacgaatagcctgcatggcgcttaatcatgataaacccatataaaagggaagcgatatatccaagcgccgtcgctaaaatcgctccgtcagcctgcatcagcttgatcagcggaacattcagcacaagcttgatcacgacgccgatcacaaggctgacaaccgcaaatttttgcttattgatgccctgcagaatggctgcgttgactgtaaacaaagagaacagaattgcgactggcgaataccatagcaaaatgtttgcccccagttcagggtgaaggctctctgacccgtaaaagaacgtatacgtcggtcctgacaatagagagatcccaacaacagccggaataattaaaaacaggatcgtctgcatcgtttgattaatctgctgatttaacagcttatagtttccgcttgtaaacgattcagtaatcgttggaattaatgtcagtccgaaagcagttgctagggaaaccgggatcatcacgagcttctgaacatacagggttagaatcgcaagcatgtcttggctgatggcttgatgaccggcttcaatcatcgctttgttaaacgtatttgtatcaatatagttatacaaagggatagctagtccaacaaaaacgtacggagcagcatagctgaacagctcgaaaaacattttcttgtagcttaggtttgctgtcggacccgtattcggcatcatcgccagcaggctgcccttccgtttgttccaataaatataaagcacgaccagccctccgaaggcaccgatcagcgctgcgaaggttgcatagccgacagcgatgacaaggccgccgttgaaaaccttcaaaatcaagaatgtcgcactcaatagaaagatgatgcggacaatctgttcaacgacttgggaaacagctgtcggacccatcatttggtgcccttgaaagaatccgcggacaaggctcataatcggtacgaccaatagcgctaagcttaccatgcggatgacataaacgacatgatcaattgtcaggccgttattatccttgcctcccagcgatatttccgcaaacatcggagccgatagatacagaatgaaaaaggctatcattcctgtgacgagcataaccgacatgcccgccttgagcattttcctgcttgtctcataatccccttttgaattatatttggaaacaaatttagaaacagcggccggaaagcccatcgtagcaatattcaaaaataaagtgtattggttgtatccgtattgaaataatgcaccgcctgtcgccccgaccataatgctgaagggaattaaatagaccatccccagaatccgcgatatatatgtaccgagcgttaatacaaacgtgcctcttaacagtttgcttgacatgtttcttcatcaccattttctacgaagattcaacttttctattttaccacaactgggcatttagacggtaataaatacaaaagcaatcctgtgaacattcatgtccgcggcaaaagacgtttaaggagcggctttctttcgctataatagtactgcggacggggtgtccgcacacgaaatgaaaagaaagttgatgataaagatgaaacaatatgacgtaattgtaatcggcggaggcccttcaggcttgatggctgcgattgcagcaggagaacagggcgctggcgtgttgctgatagataaaggaaataaattaggacggaaactcgcgatttccgggggcggccgctgtaatgtgacgaaccgccttcctgtggaagaaattatcaagcacatccccggcaacgggcgttttttatacagcgcgttttctgaatttaataatgaagacattatcaagttttttgaaaacctcggcattcaattgaaggaagaggatcacggccggatgttccctgtgaccgacaaagcccaaagtgtcgtagacgcgctgttaaacaggctgaagcagctccgcgtaacaatcagaacgaacgagaaaattaaatctgttttatatgaagatggacaggcagcagggattgtgacgaataatggcgaaatgatccatagccaggcagtcattatcgctgtcggcggtaaaagcgtgcctcataccggaagcacgggagacggctatgaatgggctgaagccgcgggccataccataacagagctgtttccgacagaggttcccgtcacttctggcgaaccgttcattaagcaaaaaacactccagggcttatcactaagagatgtagccgttagtgtgttaaataaaaaaggcaaaccgattatcacacataaaatggacatgctgtttacccatttcggcctctcaggacctgccattctcagatgcagccaatttgtcgtaaaagagctgaaaaaacagcctcaagtgccgatcagaatcgacttgtatccggatatcaatgaagaaacgcttttccaaaagatgtataaagaactgaaggaagcaccgaaaaaaaccattaaaaacgtgctgaagccttggatgcaggagcgctatctcctattcctgctcgaaaaaaacggcatctctccgaacgtatcgttttctgagctgccgaaggatcctttcagacaatttgtaagggactgcaagcagtttactgtcctcgcaaatggcacactgtcgcttgataaggcatttgtcacgggaggcggggtatctgtaaaagaaattgacccgaaaaaaatggcttctaaaaaaatggaggggctttatttttgcggtgaaattctggatatccacggctacacaggcggatacaacattacctccgcccttgtcacaggcaggcttgcagggctaaatgccgggcaatacgcccgttcttaatcattactctttaaatctcttgccgccaaactcacatttgaacattccccgcattcatgttagggtgagacttgttttgtttcacctgattgcggggtaattttaagagaggaatgagctgccatcgtacgaccatactaagcctgcgagcaagatataggcgtacacaaaaaattagagggtgagaaatgttgaaacatatatctagtgtattttggattgtgattgcaatcacagctgcagctgtattatggggtgttatttctcctgacagcctgcaaaatgtgtctcaatcggcacaagcatttattaccgattcatttggttggtattatcttttagttgtctctttgtttgtcgggttttgtctctttttgattttcagcccgatcggaaaaatcaaactcggaaagcctgatgaaaaaccggaattcgggttattatcatggtttgccatgctgttcagcgcaggcatgggaatcggcttagtattctacggtgcggctgaaccgatcagccattacgcaattagctctccatcaggtgaaacagaaaccccccaagccttcagagatgcactccgctatacgtttttccactggggtttgcacgcttgggccatttatgccattgtggcattatgcattgcctatttccaattccgcaaaggcgcacccgggttaatcagcagcacactgtcaccgattctcggggataaagtaaacggaccgatcggaaaggccattgactgtattgcagttttcgccactgttgtcggggtgtcaacaagtcttggtcttggcgcaacccaaattaacggcggtttgaattacctgttcggcattccgaatgcgtttatcgtccaattggttttaatcattattgtgacagtgctctttttactttctgcgtggagcggactcggaaaaggaattaagtatttaagcaacacaaacatggtattggccggattgttaatgttgtttatgctcgttgtcgggcctacagtgctgatcatgaactcatttacagattctatcggacaatacattcaaaatatcgttcaaatgagcttcagactgacaccgaacgatcctgaaaaacgcgaatggattaacagctggacgattttctattgggcatggtggatttcctggtctccatttgtcggcattttcatcgcccgtgtatccagaggccggacgatccgagaatttttaattggcgtcttggtgacaccttgtattttgacatttctatggttctccattttcggcgtatcagccatggatctccagcaaaaaggcacgttcaatgtagcaaagctgtccactgaaacgatgctgttcggaacacttgatcactatccgctgacaatggtgacatcgatccttgcattgattctgatcgcagtattctttatcacgtctgctgattcagctacattcgtgctgggcatgcagacgtcgtacggttctttaaatccggcgaattctgtgaaactcagctggggtatcattcagtccgccatggcggctgtgctcctatattccggagggcttgccgctttgcagaacacagcgattctggcagcgctgccgttttctatcgttatcctgctgatgattgcctctctctatcaatcgctctcaaaagaaagaagagagatcaaaaaagcggagaaactcgataaaccgagaagtcctagagtgaaaaaagcatattaacaaaaaagatctttccgcgcctgcggaaagatctttttatttgcgatataaaataagggcggaaaaacagtaaagctgctcgccgtctgggtcgcacgcggccgaaaccgtatatttgatatcaatcagctgctcctccgatatcccttttaaaaatgaattgatttccgtctgtaagtctttttcatgctcttcatcaaataccgctaccttcagcattttatccgctctcctttctctatcaatctattccgtttggaacagcgttatgatagagaaatgatgattatctcgtttccggataaaaagctttccgtatatgggattccctctgtggctcgccgccttgctgctccactttcagcagcacggcataaacaatgcgcatatgacagtagctgataaggctgacgctgaaaaaagggacaatgcccggcaggtacgcaagcaagaaaaaaagagcaacagtcagcgcaagcatagcaagcgtatattgcaaatacgccacactgagcaagagcgaaaatttcacatacagacgttttttccagtcaaaatggacaagcagcggaaacacataaaaaagcatggatacgaacaaaaagccaaatatcataatggcgaagcgcaggatgtgcagaaggaaatgacttggataaatgaaggccaaatcaatataaatgatcactccgatgagcgccagtacagcgccgagcagatttgaacgaaaaaattcacccttatattcctgccaaaacgttttgagcacgggaacgttgtcctgcccctgaatccacttccgcatgacagcgaataaagccgcggtcgcgggcatgatgccaaacacaccgagaccgagcaacgtaaaaaacagccacagcaagtttgtatacgcaaatctcatgatccattcgcaaaaacgcagcatccgtcccagtgagccatcatgttccatggcgccccctcctttttttgcattatacattctgcatctgaaaaagctctttcatgccgatcggcttcttttcggcaaccgagcgccacattccctcaccaaccgcgatggagtaggctccagcttcagccccggctaaaatatcatagcggcgcagcgggtcttttcctaaaaaaagatcctcaagcaaaagcggatcacctccgccatgccccccttcatttttgaccacttgtatcgtctgctttgattcaaaaagcggatagtattcgattgtctgctcaggaaaagcaaacggaattctggaaggttcgtgaaattcatttgattcaatacgcccttttgtgccgttgatcgtcagccggtagccttcatacggtgccgaaaaaataatcgagtagcttaacagtgcgccgccatcatatttgactgccgccacgtacgtatcctcgatgtcaatttcctcgtcaaaaatacacgcgtcaggcctgtatgcagtatataagctagactggtctcctgcttcgagatgatcatcttttatagaagctttagaggaacggggatgccaccttgaatagtagtggcatttttctttaacacggcacgtcccgcaaaaacgcccgtcttcttccggcaaggggttccactcactgtccggcccatagtaattcaaggcgccataagcaaatacctcttccggattttgcccgagccaccaattgacgagatcaaagtgatgtgttgatttatggacagaaaggcccccggaaaactgtctcgacctgttccagcgtttaaaatagctggcgccatgatacgtatcaatataccaatttaaatcaacggaggtgaccctgcctatttttccgtccagaatcatttcttttattttccgatgaaacgggctgtagcgatagttaaacgcgacggtgacttttccttcgcttttggcctccgcttcaagcacccgattcgcatcctgcactgttgtcaccattggtttttcagtaattacatctgtatcccactgaaggctttttacaatatatgtgacatgcgtatcgtccctgcctgccacaatgacgatatcaggctttgagacgcgcatcatctcgtcaaaagcatcttcgctaaactcaggcacgtgggccagctcgggaaatttctttttgcaaacggcaaaacgtttcggatcggcatccagcaatcccgtaatctcataatgagttgaaaaccgctccaacagcggtttgataaacatactgaatgctctgctgctcaatccgcaaaagacgatgttcttcaatatcctcacctctatcgggcttcagttagttgagaaatcagctgcagcgcttcctctgttttttcagcatacacagggataaacgccgccatatcgcgattcaatcgaaaagaatagccgttcagctgttttttccctttttcgatctgaacggcatagatcgttttttctcctgttttattattaacagttgtataaggagatgttttttcaggaggcaatccgtttaacggctgaaaattttccggatcattgtaagcttgaaacatgtcttcaggcacgatgaaaacatctccctcatgggcggtaatttcagtcagcagtttttcctgaaaagctggaaagatatcgaccttcccagcattctgctcggcggccttttttattttttcctgtacgccagcctgcatatcagaaaagagaatgacatgcattccgtccgtcctgcttgagcatgatgccaaaaagagcactgagacgatcacacacaaagccgtacgtatcctttttgtcatttccccgctgacctaaaaagaggctccagctctgtcatagctaaaataaacgcgccggctccgtgcagatcgtttttgcttctttcgcggctgacataatagtcatagaaaccggctgacgttccgacacatatgtctttgacgagaaacgcgccgtcttctgatgtttcggttttatgctgaatcaagccttgatacgcttttagcagtgttgtttcgtaagctctgtctaaatagcctttattgattcccttcgcaaatgcgtacatgtacaggcaggatcctgagctttccagccagttatcagacctgtctcccttatcaacgatctgataccataaccccgtctctttgtcttgatagcggcagatgctttccatcatgtcctgcagcgtgtttttccacccatgacggtttggatgcttcttcggcagctcttcaatcatgtcagcaagagacatgacgtaccagccgatggaacgtgcccaaaattccggtgaacagcctgtctcttcattggcccaaggcatttttttcgcttcatcccaggcgtgataaaagagtccgttttttgcatccttcgtatgctttctcatcaatgactcctgcagcacgacctgatcaaacagctccggctcctgcttcagattggcatatttcagtgcgaacggccccccatgtataagccgtcaagccacatttggtatggataaccgtctttgtgccaaaaaccgccctcagacgtccggttcagtgttccatataaaccgcgcagcctttttgccgctttggcataccgttcatccttcgtctgctcgtataatggaaaaagaatgagacccgcttgaatggcgtccagttcatctcttctaaataatagattgccataatcatcgattaagagatctgcataggccttcgcatactcaaaataccgcttttccccggttgcttcccacagccgcaatacaccgcataagaaaacaccctggtggtagtgccagcggtttgcaggaggcagctcctggactgtgtacgtattcataatggtttttgccaatgcctccgcgtacgtaagaggcgattttacagcgattgattgatccattgatcccatccctttcttaataaattccttcctcgccaaatttcttcgctaaacgattcgcaagcatgaccaaaatcagcccgaccgccgctttaaatacgccgactgctgtactgtagctgaattgtccctgtttcagccctgcagtataaacgtacgtatcaaaaatttccgccacttccctgtttgtcgcatttaacagcaaatacacatgctcgaagccaagctccagcgtgtctccgattttcaaaatcagcaaaacgacgataacgcttttaatggcgggcagcgtaatatgccacatttgccgcagccgtcccgctccgtccattttcgccgcttcatacagctgggggtcaaccgctgtaatggccgccagataaatgatcgtcgaccagcccgcttccctccagataacctgaagaatatacaggggccggaaccattcttcgttcagcagaaaattgattttttcaccgccaaaaaacacaatcagttcattaatcaagcctccgtctaccgttaaaagcacaaacgaaagcgatacaacaatgacccaagacataaaatgcgggatataaatcagcgtctgaacaaattttttaaagagagcaatccgcacttcgttcaatagaagcgccagcagtatcggcaccgggaaaaatatggccaggttcaaagcaaataacacgagcgtgttttttaacaagagaaaaaatgtaggctcagtaaacagcctgataaaatgcttcagccccacccactcactgcccaaaatgccgaggaacggctgataatcctgaaacgcaatcacaattccccacatcgggacatacttaaaaagcaaaaaataaatacaccccggcaaaatcatcaagtacaaatatttttgctgaatcagcttgattagtaagcgctttcttttttcttttttaaaaatgactgtatcaacagccggcgcttgcgcttctgctgttttcattttttcccatcctcctttcacgggttcttgcattcactgtagcgcagaggtaaaagtccgtctacaatcatatgatcacatcctgttttatccctttataatcaaaggttcaggaggtccacctgaaaaaaagacaccgatattagaaaatgattattgacaatatctatcaatctttggattaattgtattaaggtgaagtggatgttatgaaatggggggttttatgaaaagaagccaatacaagttttactacaaactgattacgtttttctgcctgctcagcaccattccggttattttggtcggattgttttcgtacgagcactctcagaaaacggctatatccaacgtttcagaggaaaaattcgacacactccagcagacccagcaaagcatcgagcatatattgaaaaccgtcgatcactctttaacccactatgtgagttcgccgcctctccttcgcacattgtccgagcctttgcactcagaccaatttcaaatctataaccaagtgaaccaagagctcaattatctgcaaagctttgataccgatctgtccaacatgacgttagtcagttatacgaaaaaatggtacatgaacaattccggtttgtaccgtttgaatacagacactcttcatgaagcagcctcagcgtacacgaaacaaaaagcgagccgctcctattggacgcttgaggaaaacaatcatttgatttcaaccaaagaaggcacagcagaaaactgccgctacaatatcaatttaattaagcagcttcctttgaacagcacaaatacaaagggattggccgccgcaagcatcccgagctgttcgcttgtcaaaaatatgcccggctattcaaacgccaacaacctgtttatcatcgatgaaaaaggcctcatcatccttcataacaatatgtctgacgttggtgaatctcttcataacgacggctttgtccaaaaagtgctggcgcaaacggccaatagcggacagtttgaaacagttattgaccggattcattataaagtcacctatcaaaaatctgactataatgcatggacttatttttctctcgtttccctgcctgagttaaaaaaagaagccaaatcaatcggctggatcacttttgcagtatgcctcattttgttaacgctttcattgctgttctcttggcttggctcccgccatttttacaagccgatcagggtgctttacgaatcattcgcaaggcatggtgccatacaagaaaaacagccgcctcaaaatgaatttgagttaattgaacagagctttaagcagctgaaggacagaaatgatgatcttgaagaaacgatgaagcagcaagccacccacctgcagcaatattttatggtcaggcttatgctcggaaaactgacggatgaggaggttaataaccgttttgaaagcctcggtttaaagcaaaattggcggcaccttgccctgcttgtgctccaaattgacacactgaatcatacgccttatgagaaaaaagatatggatctgcttttgtttgccgtcaacagcctgattgagcgcaacatcccgacggacaaacatcttgcccccgccgtagttgacaaacagcaggcgacgattttgatcaatcaaagcgggacaaaggaagaattcatggctgagctgaatgagactgcaaggatgattcaggaaaaagcggaagctgagctgcagctgtctgtcagcatcggcatcagccagccgtttgatgtgctgacaaaagcgaaaacagcctatgcggaaggctcagaagcgttgaaatatcggctgaaagcggaaaacaagtcgatcatcttttacgaagaccttgaccagaaaaaaaccttcaaaacccattttccaaagcagcttcagcatgagctgttcgatgctgtcaaagcaggagacaaggagaaagcggataaatgcctgcacgcgattttacaagccattttcacccagaacaccaacccgtatcaatttcaaatcgccatcgcccgttttttgaaccatgtgattgagctgatgcatgtgcttgggatcgaattgtttgagcttgaagaaaacaaaatgctgtatgaccaaatttttgagctgaaaacgttcgaggataccgaaaactggctaaagaatgagtttattgatccgatgacagacaaagtgaacgcccgcgcggatgcccagtacaaaaatatttccgacaacatcattcatatcatccatcatgagtttgaatccgaattgacactggacgaaatcgcacgcaggctgcattacaacccaaattatttaagcagtattttcaaaaaagaaatgggaatttcattcagcgagtatgtctcaagctaccgacaccatatggcgaaaagctggcttgccgaaaccgacatggcggtcaaggacattgccgaaaagctgaaatataaaaactcgcaaaacttcatcagatcatttaagaagctggaagggattacaccgggaaactaccgccagcaaaaaagaagcatgtaaaaaacccaaaaccgcttgcgcgttttgggtttttccaatgttattttgcttgtttaaacgcttcttcgtattcctgaataatttgttttcctccgcttgactcccatttttccacttctttatcgaactggctttctgtgatgtctccaatcatatatttgtaggtcgcgtcatcaatgattttcttcagttcgtcaccccgttccgactccgatgcggaatacaggctttcagccgggtttgagacgataatcttttcattgtcctcggtcagctcctcgtacgccgtccgaagcggatctccagtgttttttaagtaggctttatcaatggcaattaaagcggacagcggctgaatatcagtctgccagtcttttacctggctttctttgcgtgtaaacgttttgtcctcacctttgttgtaatgaacgccgtcaatgccataagtcatcaggctatagacatcttcttcggcaattcggtcaaaaaacgccaagatccgtttaagctcagcttccgttttcacactcgttttcgggaaagcaaacacgccgttatggcctcctgatgcccatacccgctctttcccatctgggccttttatgcggttgatgatctcgagcttcatcgatttatcagaggcatggtcgcgcagattgaccgcatctaccatattgccaatataaattccggcttttccttgagaaaacagctcctgctgctgggttttgcttgtgacgggaaaatccttattcatatacccgttatcacgcagctttttcatatagttcatcgtgtctttgtattcctgtgtcatgaaatcaggcgtgaatttgccgcccgattccttccaatctgtcggcatgccttcatacgagccaatcgttttaaacgcgccgtaaatcaagtcattacggtctgccagcccgatcgtatcatctttcccatccttgtccgggtcgtcctccgtaaatgctttggccacttcataaagctcatccaacgttttcggggttttcaaatttaaattgtccagccagtccttccgaatgacgatcccctgtctggaaagcgggcgctctctgtatatcccgtagagctttccgtcaattgtcacatttttattaatgagtttgttcattttgtttaagttgggataatccttgatataatcgccgatttcccaaaacattcctgaccgaaaggcattcatgactgacgaatttttaatatcctggatggtcacgatttgcggaagattcccggctgcaagcgctgcattcagcctgtcttctttcaccgcgtctggaacccaggtgatgtcgagttctgtatttgtcagcttttcaatttctttaatcgccctgtccttcggcggctgctgatgatacaaaatcgccatccaagacagctttatctttgaatctgggccagctttgccttcagccgaagactgatcagttcctttacagcccgccagcactccgccgagtgccagtacaagcacaatcaaaagcaccctccatttgtttcccatcgtacccctccgtttcatatttctttatcctttgacagatcccagcaaagctccttttgcaaaatgcttttgtataaacggatagacaagcagaaccgggatggtcgccaccactatgaccgccattttaatggtttgctcaggcggcgggctgcccgaccccatttcagacatatccccctgcataccgcttgatacaatgacgatttggcgcagaagaacctgaattggccattttgctgaatcatttaagtacaagatcgctgtcatatacgtgttccaatacgtgaccgcataaaatagtgaaatcgttgcgatcgcaggaagagacagcggcagcacaattttaaagaatatgcccagatcattgcacccgtcaattttcgcggactcttccaggcttgatgggatattttgaaagaagtttttcagaatgatcaggttaaaggcattaatggctgtcggcaaaataagcgcccagtaagaatcgagcaatccaagcgatttgaccacaaggaaagtcggaatcatgccgccgctaaacagcatcgtaaatacgacgagaaacatgagcggctgccggccgattaaatcatggcgggataacccgtaagccatcagtgaagaaagaaacatgctgaccgcagtgcctatcactgtcacaaacacagaaacaagcaaactcttataaataatatctgttgaaaaaatgtagcgataagcatctagcgaaaaagtggtcggtattaaaataaattttttcgacacgacttcttctactgtggcgaaggatgctgcgatgacatgaatgaacggaagtacgcatattaaagcgaacatcagcaagaaaccataaatcaacatatcaaacagacggtttttcagtgaatgtgcgatagctcccacctctctttgtaagcgttatcatatttcggaaaccgagctcagcatgtgacgatatcgtgtctaaaatgtagcaaatctgtgattgccatgtctataatcatttgaacagtgtccccggccgggcgggggctgccgcgaattgagaccgataacaaaagaaaaagagcataatcttagaaaatgattatgctccgttctcctcctcgttcagaagttcagccgtattgatttgtggcgaaaacccaagttcattcacggcagattcaatggaccatggccggcccggattatcagagacggcgtaataagtgccgtaccggatattggtctcaatagcggctttgaaaatcgacagcagatcggggtgagaaagcagtgtctttttcgtccgttctttttcatgcagcgtatccatttcatctgtgacgactgttccgattcgcaggttgattactgatagcttattttccaaataaaacaaatggccgatctgttcagaggtcagctttaatacaccgtacaagttttttgacagcggataatcgcttgttgtgatttcccgtcctaagagcgagcgcccgtctttttcgtagacatctgtgacatgattactgctggcgaacacgagcttttgaatgccgagctccgctgccgcacggcacagataatagcttgccctatagaaaacatccgtcattttttcaaactcagcgatgtccataatatcgtatttgattttcacagcgagtaaattcaagatgacatccgtatcttttggaatcttcttcaacagctcctcataatttgccgcgtcagcctgaatggaagaggctttgccatcgaaatgatctttatcaagcacagtcacttcatagtctgaaataagcccttcagcaagcagtctcccaatcacaccatttccgccggcgatcagcacttttttcactatgttcactccccttttttatagattgcccattttcggcggggctgacacttttttggcactcacattcttaggcttattcaaaagtcaccggcagctcctcaagcgcccgaaatccaaaaagcggccgataccgccattcaaaatccgcgagattaaggctgggcattcgctgcagaagagtgttaatcgcaatttgcgcttctaatcgtgccagcgaggaccctaagcaaacatgatggccatgcccgaatgaaagatgcggattaggacttctcgtaatatcgaagacatcggggttcgtgaatatgctagggtctcgattagccgcccctaacaaaagatagacttgttctccttgacggatcgtcaccccgctgatgtcaatatcctctgacgcaactctggctgtcatttgcgtggggctttcatagcgtaaacattcctcgactgcggtatcaataagatctggattttctctcagtttcaaaagctgttctggatgctgcagcagacaaaggactgaattgctgatgagattgaccgttgtctcatgtccggcgatcgccagcaatatgcacgtagatgccgcttcctcttccgtcagcttatccttttctttccccttcaagagcatgctgatcatatcctgttgagggtggcgttttctcttttgaatcagctctttgaaatatgccatagcctgcacagccataatattgccctctgttaatgcctttcttgagcgggtaaaatcaatcgtttgaatgagactcgcagcccactcctttaattgctccctatcttcctccggtacacctataatgttagctatgacaaaacttgctaaaggaaaagcaaagtccgaaatgacctccatcttttttttaccttgcacttgatcaagcaaatgatggacagtttcaatgatatacggctgataactctctgtcgttctcggcgtaaacgctccgctggcaagcgtccgcaatcgtctatgatcaggccggttctgaaacagcatcatttgattttgcacatgtgaaaggtcctgatatttggttgagctctcaggcagcggggtgcggactttgaatctcgcatctttcaaaatagcagccgtttcttcatatcctgtgacataccagcccgggtattttaagaaactccctttatagataggatgaacagctcgcaatgtgtcgtaaaaagaatatgggtttttcaaaaactcagaagatgcagttgacgatgcaattgtcacgtgattttctcctttctgttcaaaaataaaagcaatcgacatcataccgattgcttttattgattctttcagcttttcgcacttaaactggccttcatttcttcgactgattcaacttcaaagcctaaatcactcagcattttatgatcctccgtctcctcttgcccggcagttgttaagtagtctccgacaaaaatggagtttgcggcgtaaagccctaatggctgcaatgagcggagattgacctctcttcctccggaaatgcgaatttcttttgatggattgataaaacggaacagcgccagcacttttaaacaatacagcgggtttaattcgttgacgccttctaacggcgtgccatcaattgcatgcaaaaaattcaccggaatggaatccgcgtcaagagccttcaagcttttggcgatgtcaatgacatcctgtttcgtctccttcatcccgataatggcgcctgaacacggagacagccccgattcttttgcgatttcaaccgtattgactctgtcatcgtatgtatgtgaggtcgtgatgtttgaatggtttctctgtgacgtattcaaattatgattatagcggtctactccggcatctttgagacgcttcgcctgctctggcttcaacagtccgagacacgcacaaaccttcagtccatacgtctctttaatttcctgaaccgcatctacgacctgatccacttctctgttagacggccctctgccgcttgccacgatacaatatgtgccgatattcagatcgtgcgcccgcttcgcgccttcaagcagcgtttccttattcaccatccggtaagactcaatcggcgctttcgaaatcgcagactgtgaacaatagccgcagttttccgggcagagcccggatttcgcattcataatcatattgagctttactttttttccataaaagtgttttctgatatgaaaagctccatgcattaatagcaaaatatcttcatcaggacaatgtaatattgaaagcgcctcttcgtcagtcacttctgctccagccagcacccggtctgcgagttccatccattgattcattctcatacccccacttgattcatcagtaatgatagattgatatggtcttttaccatatgtagaaccgtttctttcgtcacgttggcaagctttggcgtaacccctaaaatcggcacaccgcataagcgctcaatcatctcaggattggttttttcatcttcatcaggagagtcactgattccattgatgataattccggcaattggaagccccatgctttctgcatatttgacagttaaaaaggtatgattaatggttccaaggtgaggacgtgccacaataatcatgggaagctgcaacgcttttatgacatgactgaccaaatagtcctctcccaatggcacagaaataccgcctgcaccttctacgatgaagcattcatgtttttctctaatccgcccccaatggcttaaaacctcttccatggtgacagtctttccctcaagtttccctgcaacgtatggtgcaagcggcgctttgaaggcaaaaggcgtaatgtcttcatgagaaagactggtctgcgacatgtctttcagcaaacttgtatcactatctggatgatgacgcgatatcccgcttaaaaatggtttatacacaccgacatctctattatgttctttcaataaggcagcaagaccgctggatataaccgttttccccacttctgtatcagttcccgtcacaaaaaaacccctcaaatgatatgcagctcctttccgattgaatgaaatgttttcagcaaatcatcaatatcacccatactgtggtcagacgtgattgtaattcgaatacggctttcacccggtgcaacggtcggcggccgaatggcaggagcataaattcccttgccctgcagtttttcagcaaataggaccgttttatgggcatcgccaatgactacaggaataatcggtgtgtgatctcctttcaccacataacccatattcttcagactggttctgatcgtactgatataagaaaataaaagctgtcgtttttccctgctggcttcaatgatgttgaaagcctcatgagcagccgcacagctggctggcggaatagcggtttgaaagataaatgttctggcatggttcagcaaaaagtcgatgaagaccgctgatcctgccgcaaaacctccttccgcgccaacagctttgcttaaggtgccgatcacaatgtcgggacaaacaccaaagtattcactcgttcctcctcccgaatcgcccaaaactcctgttgcgtgggcatcatcaacgaccacgaaggcatgatagcgtttcgcaagtgagatgatctgatcaagaggggcgattgtgccatccatgctgaataccccgtctgttacgataaaacggcgctgataacgctgtgtttcattcagcttgttttcaagatcattcatatcaatatgccgataaacaactgtatcagccttagaaagtcggcagccgtcgataatacttgcatgattgagctcgtcacttaaaatgacatcttccttttctggcaaggatgaaaggagaccgacattggccaagtaaccgctcgaaaacagcagggccgcttctgtccgtttaaagctggcaatcttcttttctaacttttcatgccagaccgaattgcctgtcgttaaacgtgaaccgctgcttcctgtcccaaattgctgcaatgctgtttgggctgcatcgatcaaacgtctatcgcttgcgagccctaaataattgtttgaggaccagaccgtttgattttcgccatcaatgttccgctctggaaccggcgctccatccattgaccgcaggttacggtgtacgccggcttcctttactatgtctaaccgctcgtttaaccaggaatcaatcttcaaggctcgtaacctcgtggatcgcttgtttcataatggcaaccatttccgagagctcttcagctgtgctggcaagaggaggaagaaatgcaatcacgtccccaagcggccttgtcagcattcctaactctctcatttttaaggaaactttgtatccaatccgccgatcagccgggtaaggttctttggtttcctttgatcgtacaagctctgcaccgcacataaagccaagctgccgaatatccccaacataaggaagagcgtgcagatcttgaagaagaaaatggagctttttactttttttcgctacttgttccacaatgttttcagattcaaataatgccagattttcaagcgcaactgcacagccaagctgattgcctgtataggaatggccatggaaaaaggtttttaggttttcataatcatcatagaatgccttatagatgtcttcagtggcaaacgtaacggcaattggcaaatagcctcctgtaatgcctttaccggcagccatcagatcaggctggacattctcgtgctcgcacgcaaacatttttcctgtacggccaaagcctgtagcgacttcatcaacgatcattaagacatcgtatgttgtacatagctcgcgcacgcctgccaaatatccttccggcatcacgatcataccggaagccccttgtaccattgattcaatggaaagcgcggcaatttcctcgtgatgttccttaagcagctgttcaagctctcggaggcactgatcacggcactcatcaggatcaccgctttcagagcgatacacataaggaatcggggccttgtaactctcgaacatcaacgggccgtatacgtggtgaaaaagctcaattgaaccgacactgacggcgccaatcgtatcaccgtgatacccgtttttcattgcgataaatttttgtttctcgggcttcccgatgttcttccaatactgaaacgccatttttagggctatttccatcgcttctgcaccgctgtctgaataaaagacccgcgtgagcttttttgggctgatatcgattaatgtttcggcaagctgggttgctggaacgttggtcatgcccaataacgtggagtgcgcaatttttccgagctgtttttttatggcattatctagttcttttttgcggtgtccgtggacattaagccaaactgatgaaaaaccgtcatagtattccttgccatttatgtctttgactttgattccagtcccgctttcgatgattaaggggttttcatcataatctttcatttgggtaaatggcagccagaggtgctttttacttttttctatcaaatcatgagtcatgatcttcctcccactctattaaaataggctgcttctccagatcatgtatgtacgtgtttacatcattggatccatcaataaaaaagactcggcagccctcttcagtcccgtattctttcattgctgtaatacgctgatagcccattttcttacccgcaacatagcctgttatgtaatccggatcgtccgaccagcataattctgcaacggctgccgggtgccggcttacctttgaagcgagcgcaagggcctcttttattcttgaatgagccggcacgtgactgtgaagcgcccatttttcaaaattagcgtccggccaatccattctggagacccgcacccctttttcttttgtttgatccattcgctttcctgtatgaatatcaaacaacaccgcacccctgatatctgaccattcagggatttgttcatatgctttttcaatcacgtctcgtgaaacgccttctttttccaataacaatcgggccagcttttgcccttcttccgggcagctcacttcattcgtatgcacaggcaatggctgaatggtttttatcgattcatatacctcttcaaattgaatttgcataaaatcaggttttcctcttgaatgggataaccctttttctaataaagcattgactgtatgcttcatctcatggaaaggtataagccgttctccgccggatatatgctttccgccgtcttcatgagatccattcatagaagccctcattctgacactataaaaagtttcttcttgcatcatttctcgccctttcactgataactgaagaacgtgtagtgcttctcaccttaattgttaaccaattatattttaaggttaacaattagaatatattattctctcctgtttctgtcaatagaagaaagcatcgatttatggcagttggttaaaaggaaacaaaaagaccgttttcacataaaacggtctttttcgatttcttttaacagtcacagccacttttgcaaaaaccggacagcttcatgcctcataactgctgtttcgaaatgtcccgaagcagaacggaccactcggtagcaatcagaagctccctgtccagcatagacagctgtcaattctttttcgattttgtccacgccctcggccggcgttaaccgatcgtgtacaccaacaagactaaggtgcgggcgcggcgcgatcaggccttggatctccgatgcggaaaaatgctttgcaagcgatgggacgtaataataaaagccgtgcctgtcaagattctgtgttttgatcagcacgtgatgatccacctggctgcacaaatccacacacaccttaatccggtcatcgagcgccgctgtccaccacgccatcaaacctcccatagacatgccgatggttccgatcctgtcaggctgaacatcagagcgtaactgcatatagtccaacgcacttaaactgtcataaatcatcatcccccacatcacttttccggtgagaagcatttctttaaatatctcgctttccgcttttccccgccgatctccaaatccccaatgatcaatcgcaagaacgccgtatccgagtgaagtaagctcatcagaaaaagaaggcgttttcaaataatccgctccctcaatcagctcactttttcccctatcatactggcccccatgcgaatgctgaaacaatacggctgggcacggtccttctgttttcttcggcttcacaaaataagcgggcaccttttcatgtccatttaaatcgagcaggagcgtttcaacgatattttcttctctttcttcaatacgtaatgtctcaacactgattggcctccgatcaggcaaatcaccaagcaatcgaaacagttgctttcttctttcggctctcatcccatcacccttccttattcgcttacttcacatttacgagacagatctgggttcccctttatttttccaacataaatcacatcatttactaaatatttagtaaatattatgaaatatttcgaaaacaattattgtaaccgcttacttttatatgatagtatcaatttatcaaaaacagatgagttaatattttactaaatagatgagagggatacccatggttcgtattaaagatatcgccttgaaagctaaagtttccagcgcaactgtgtccagaattttaaatgaagatgagtcgctttctgttgcgggcgaaacgagacaaagagtcatcaacatcgctgaagagcttggttatcaaaccgttgccaaacgccgaaaagcccgcgggcaaaaacagcgggctcagccgctgatcggtgtgctgagctgtctgtcccctgatcaggaaaggcaggacccttatttttcttccattcggaaagggattgaaaaggaatgctttgaacaggaaattttcattacaaattcgattcatctcggctcctttcaggaacatatctttcgggaattggatggtgtcattgtcatcggccgtgttcatgatgaagcggttaagcatatcagcgggaggctggagcatgccgtatttatcaatcattcaccagatccgcaagcatacgattcgattggaatcgattttgaatcggcttcacgccaggcgattgatcaccttttcgacttaggctacaaacggttaggctacattggcggacaagaaaaagagcatacgctgaaggacggccaaagcattcgcagaacgattgaagataaacgcctgaccgcttttttggagtcagccgccccccagcctgagcatgtgctgatcggagaatacagcatgcgtgagggctatcgcctgatgaagaaagcaatcgatcaaggccatctgccggaagcattctttattgccagtgattctatggcgatcggcgcattaaaagcgctgcaggaagccggactgcaagtgccgcgggatactgcaatcgtcagctttaacggcattgaggaagctgaatttgccagcacgcctttaacaacggtgaaggtatacacagaggaaatgggccggacaggcgtaaaactgctgcttgaccgtctcaatggccgaacacttcctcaccatgtcaccctgcccacaacattaattgtaagacaaagctgcggatgtacagcaaaggaggtgacataagcaaagattcatcacgatgataaggaggaaaagatgaaacacacttttgttttatttctctcttttattctgcttgttctgcccgggtgttcagcagagaaaagctcagcagataccgcaaaaaagacgttaaccatttattctacaatgtcaaccgacagtgaaagagatacgttcagaaaactagcggcagcattcgaaaaggaaaacagtgacattcatgtcagccttcatttcccaggcaatgactatgaaaatatgatgcgtgtcagaatggcggccaatgatttgccagatctattcgatacacatggctgggggaaaatcaggtacggagaatatacagcggatctccgggatatgaaatggactcaagatcttgatccaaatttaaacagcatcctcaaaaataaaagcggaaaggtgtatgcctatccaatcaatcaggcaaaagacggtctggcgtataatcgcaatattttagaccgttacggcattgctccgccggaaaccatggatgactttatcaaagcactgagaacgattaaagaaaagagcaagggaagcattgttcccttctggtttgccggatatgacaaaagctcattcgcccaatattacgaccaattcgctacacctcttctcatcacagaccctgcccataatgaaaaaaaacagctcaccaatggcactttcaaatggaataaatttacttacttatcgaaaatcctcaaacaaatgcagaaagaaaaattgattaacatcgacgccgtcacggcaaaaaaatcacagctcattgaattaatggcccaaaacaaaatcgcctttacaatgcaaggcggcacactcggccaagacgttgcccagatcaatccgaacgtcaaggtcggcattatcccgacacctgccatccatcccggtgatgacccgatatggatcggcggtgaacgctacacccttgcagcatggaaagattcgcctcaattaaaagaggcaaaagattttatcgcatttatggcccgcccggccaatgccaaacaaatggctgaagccacatcgcttccttcagggctgaccaatgtgaaagctgatattttctacgcaaacgattatgagcattatcaagatgtcaaagtcgagccttacttcgaccgtttatacttgccaaacggaatgtgggatgtcctaggcacggttgggcaggagctcgcggctgacattttggcgcctcaagacatttcgcagaagctgggaagagaatataaacgactccgggagcaatcggaaatacagggagctgaaaacaatgagtgagatcgcaagggacgttcatgtgaaacaggttaagccaaaaaagcagtcctcactttggtggatgtacattcctgctttgctctccgttctggtctttatgatttatccgtttgtgaaaggcacattgattacctttacaaactggaacggcttttcacaagtttaccaatgggttggattcgcgcaatatgaaaggctgttttctgatcctgacacttggcatatcttaaaaaacacgctgctttacgggcttggcagcactttttttcaaaatgtggtcgggcttctatacgctctgctcttaaatcaaagcattaaaacgaaagcggtaacaagaacaattgtgtatttgccggtgatgatcagcccgctcattatgggctacatatggtactttttcttctcctatgacggaggcgcgctcaacgatttgctcggggtcttcggcatcagccctattaatgcgctcgccagtccctcgctcaatccatggatcattgtcatgattaacacctatcaatatgtcgggattgctatggttgtctacttagccggtctgcaaagcattccgaaagactactatgaagcggcgcgaatggatggcgcgaaacaaggccagcagttttttaccatcacgctgccgctgttaatgccctccattaccattaatatggtcatcaatattatcggaggcttaaagctgtttgacgtcatcattgcactcaccgcgggcggtcccggaaatgcgtcacaatccatgtccacgtttatgtatgatttgtatttcaaacggcaggatgccggctatgccgcaacgcaaggcatatttatggcatttgtcattttgatcatcagcttttgcgcgcttgcgtactttaaaagaaaggagacggaaatgtcatgagagccgtccgtacaaaaaacatgcggatcattacgcttcttgccgccattgtggcctgtgcgcattttattcctttttatatcctgctgaccacttcattgaaagcaaaaggagactacagttcgaaatggatatttccagccaacatctcctttcacaatttctcagaggcgtgggagcgcgcttcgctaggtaactcttttataaacaccatgatcatcacaggtttttctgccttgttattaattatattcggctcacttgccgcctacccgcttgcccggagggaaacgaaactgaataaagccgtttttgccttgctgatttccattatgatcatccctccgttaacgtccatggttcctttgtaccgaatggtcgtggacgccggaatggtcaatacacacgcaatcgccattttcatcaatacagcagcttacatgcctttaaccgtattcttatattcaggctttatccgatcgaccattccaaaagagcttgaagaagccgcaagaattgacggcgcaggcatgctgaaaatcttttttacgattgtgtttcctctgctgaagccgatcactgcgaccatctgtattatttcttgtgtctttatttggaacgactatcaatttgccattttctttttacaagatcaaaaggttcagacattaacagtcgccatggcaagtttttttggagaaaacgcaaacaacctgcatttagttgccgcagcggcacttatggcaatgctgccgatggttgttctgtttttggcgctgcaaaaatactttattgccggcctgtcttccggagcggtaaagggttaacattaaagggggaagcaatatgaaaaagattacatttatcggtgcagggagcacgattttcgccaaaaatgttttgggagactgcctgttaacagaggcactgaatggatttgagttcgctctttacgacattgatcccaaacgcctgcaggaatcccagctcatgctcgaaaatctaagagaccgttataacccaagtgtggccatcaacagctatgatgacagaaaactcgccttgcaaaacgcaggctatgtcatcaatgcgattcaggttggaggatacaaaccgagcacagtcatcgatttcgagattcctaaacggtatgggttgcgccagacgatcgccgatacagtcggcatcggcgggatattcagatctctcagaacaatcccggtcttatttgatatcgcaaaagatatggaggaaatgtgccctgacgcatggttcttaaactatacaaatccaatggccactcttacaggcgccatgctccgctataccaatatcaaaacaatcgggctctgccacagtgttcaagtgtgcacgaaggatttatttaaagctctcggaatggagcatgacggaattgaggaacgcatcgcaggcattaatcatatggcttggcttttggaagtcaaaaaagacggcacagatttatatccagaaatcaaaaggagagcgaaagaaaaacaaaaaacaaagcatcatgatatggtgcggtttgaattaatggataagttcggctattatgtcacggaatcgtccgaacataacgcagagtatcacccatactttattaaacggaattaccctgaactgatcagcgagctgcaaatcccgctcgacgaatatccgagaaggtgcgtcaagcagattgaaaattgggagaaaatgcgggatgatatcgtcaataataaaaaccttacgcacgaacgctcaaaggaatatggttcaagaattatagaagcaatggaaacaaacgaaccattcaccttcggaggaaacgtcttgaatacagggctgatcaccaaccttccttcaaaagcggttgtggaagtgacatgcgtcgccgacagaaaaaaaattacaccgtgcttcgccggagaactgcctgagcagcttgccgccttaaaccggacgaatattaatacacagctgatgacaatcgaagcggctgtcacacggaaaaaagaagcggtttaccaagctgcaatgcttgatccgcatacaagcgcggagctttccatgaaggacatcatctccatgtgtgacgatttatttgcagcacacggcgattggcttccggcatacaaataaaaactaggggaccgctctcccctagttttttggttttgtttcgccttcccaggccatcatgccgccttcaacattgactgttttaaagccttgctcatccaggtacttgcagacgttcatgctgcgcattcctgagcggcagataaatacgtactctttgtctttatcaagggtttccattttttcaggaatatcccctatgcgaatatgaacggcttgcgggatcatgccttccgctacctcttcatcttctctgacatcaattaaatataattcttcgtccgcctcaattttttctttcaaagcggctgtgctgatttcttttatttccaaagaaaacactcctattcacagtgatcatgttcagtatatcaaagtcagctgaacgattgctattctgagactgatgaaaaaaatccccttttggcaaaggggattttttctaggcttagtttgccacaatattgacaagcttgccaggcaccgcgatgattttccgaatcgttttgccttcaagctgctctttgaccttttcatctgcttgagcaagctgttccagctgttctttcgttgcatcggcaggaacctgtaatttcgcttttacttttccgttcagctgaataacgatttcaacttcatcatccacaagttttgtttcatcatatacaggccaagcttcgtaggcaattgtgccggaatggccaagcttctcccaaagctcttccgctaagtgtggcgcgacaggagaaagaagcttcacgaagccttccatatattctttcggcagttctgttgctttataagcttcattaataaagaccatcagctgggaaatacccgtgttgaaacgaaggccttcataatggtctgtgactttcataaccgtttcatgatagacgcgctccaatgtttcacccgcgccttcaacgattttgtcattaagctcaccgctgtcttcaataaataggcgccatacacggtcaaggaaacggcgcgcaccgtctaatcctgattcagaccaggcgattgaagcatcaagaggtcccatgaacatttcgtacaatctcagcgtatcagcaccgtgagaggccacgatttcgtcaggattgacaacgttccctttagatttactcattttttcgttgttttcgccgagaatcattccttggttgtacagcttttggaacggttctttcgtcggcactacgccgatatcataaaggaacttatgccagaagcgggcatacagaaggtgaagcacggcatgttctgcaccgccgatatacatatcgaccggaagccatttttccaatttttctggtgatgccagctgatccggattgtgcggatcaatatagcgcaagaaataccagcagcttcccgcccattgcggcattgtattcgtttctcttcttccttttttccctgtctcagggtctgtgacttccacccactctttaatgttcgcaagcggtgattcgcccgttccgctcggtttgatttcatccgttttcggcaaaatcagcggcagctcctcttcagggacagctgttgacgttccgtcttcccaatgaatgaccggaatcggctcgccccaataacgctggcggctgaagagccagtcacgaagacggtatgtcactttcttctcaccgtttttcgtttcttccagccaagcgatcactttttcaatcgcttcctgtttgtgaaggccgttcaggaaatcagagttcacgtgctcgccgtcgccagtataggctgcttcctcaacgttccccccttttacgacttccttcaccggaaggccgaatgttttggcgaattcaaaatcacgctcatcgtgtccaggaactgccatgacagcacctgttccgtatgatgcaagaacataatccgcaatccaaatcggcagtttttctccgtttacaggattgatcgcatacgctcctgtaaatacgcctgtctttgttttcgcaagatctgtgcgttctaggtcactctttgattgaatttctttgatataagcttcaacagcttctttttgctctgccgttgtgatgttttccaccaatgcgtgttccggggcaaggacagtgtatgtagcgccaaacagcgtatctggtcttgttgtaaacaccgtaaaggaatcatcatgtccatctatagcaaaatgaacgtgagcgccttccgaacggccgatccagttgcgctgcatatctttaatgctttccggccaatcaagctcttccaagtcctcaaggagcctgtccgcataagcggtgattttcagcatccactgcttcattgggcgtctctctaccggatggccgccgcgttcgctcttgccgtcaatgacttcttcgttggcaagaacagtaccgagcgcagggcaccagtttacaggcacttcgtcaacgtaagcaaggcctttttcgtatagctttaagaaaatccattgcgtccatttatagtattcagggtcagtcgtattgatttcgcgatcccagtcatatgagaagccaagcgcttgaatttggcggcggaagttatcaatattctgcttcgtaaacacagcggggtcgttccctgtgtcaagcgcgtattgttcagctggcaggccgaatgcgtcccagcccattggatgaaggacatcatagccctgcatgcgcttcatgcgggacagaatatccgtagctgtgtatccttcaggatggccgacgtgcaacccagctccagacgggtaaggaaacatgtccagcgcgtagaatttttgtttttcattattatcaagagtggcaaatgttttgttttcaagccaatatgtttgccatttcttttctatctctttgtgctgaaaactcaaagtaaaaacctccttctgattgaatacggcgtgtatggttcaagtattgacgggaaggagaggattattcagaatattcccaaactaaaaaaaactccctcatccctaaaagggacgagagactttcgttttcccgcggtaccaccctcgttagcgcggcatacgccgcactcacttgatacttttaacgcagttatgcgtcagcggcttttcaccgctgcaactctgaggtgagttcggaaacaaacttgattgactttcaccagccgtcaactctctgcaacaatatctgtttcttactgctcctcttcattgttcttatcgcaaccgtaatctaactgtattttatagaattctgttcataagtgcaagcaggtttgtatacaatgggaatgtaccctgaacgggcggagattgaggacaattattcgggtggagttttggtttgacgtttggactcggccggttcgccgccgctgttcagttctctcacaaagtcaaaacttctgagaacagcttcaccgccgtagcctgagataatggataagatgacaagttgaattcctgaatcggggtcagcggataatacaagtaaaatggaagccgtcatgccgataaaccaatcttccaaaaatccaaggtagataaaccgcttcgtcattctgggcttctccagcctgcctctctttttcacatgaccgagaatccccatgattcctccaattacacaagcaatgagtacctgatgcagcatcttcatcatcaccttcctaaagcccttatttcgtaaagcgacttcaggccatccagcccccttaaacgattccgatgattttcgatatctacataccggcaaatctgtaaaaagcttgtttcttccattatatgtgaacacatgatcggtaagcttgatgcattggattcatttttcacccagtgacattgacctagtcacctatttagcatgtaaaaaacctttccgttcatatgttcaaattctgttcttatttttagtgtatacgaggacaagccctaatgacaaacaacaaactgcacttgcttgaatcagaacatgtgttgtgctacggttactgtagaattcattttaaaaaggggaatatcaggctttcgcatagcaagctgacggcctaagggggatttatatggctagttttcaatcatttgggataccaggacagctggaagtcatcaaaaaagcgcttgatcacgtgcgagtcggtgtggtaattacagatcccgcacttgaagataatcctattatctacgtaaatcaaggctttgttcaaatgaccggctacgagaccgaggaaattttaggaaagaactgccgcttcttacaggggaaacacacagatcctgcagaagtggacaacatcagaaccgctttacaaaataaagaaccggtcaccgttcagattcaaaactacaaaaaagacggaacgatgttctggaatgaattaaatattgatccaatggaaatagaggataaaacgtattttgtcggaattcagaaagacatcaccaagcaaaaagagtatgaaaagcttctcgaggattccctcacggaaattactgcactttcaactcctattgtcccgattcgcaatggcatttcggctcttccgctagtcggaaacctgacagaggagcgatttaattccatcgtttgcacattgacgaatatcttatcaacatccaaagatgattatttgatcattgatttatccggattggcccaagtgaacgaacaaacggccgaccaaattttcaagctgagccatttgctgaaattgaccggaactgagttaatcattaccggcattaagcctgaattggccatgaaaatgaataaactggatgccaatttttcgtcgctgaaaacatattcaaatgtaaaggatgccgttaaagtgcttccgattatgtaaaaagatcccgctcacccagcgggatctttcagattgttgacaaaatcctaaaatggttttcattttaggattttgtcatcttttcagcgtgattgaaaacccttgaagtctaggaaggacgagcataggagcggagcgaatgttctaattcgtgagcaccgaagcgcaggcctgacaacgaatgcgagggtttgtcgacacgctgaaagatcccgctcatccggcgggatcttttattatgaagagattgatgcctgcttatttgtttctttagctgattttatccgtttgtcatatagaagcgttgtggcaatactgatcagcagcaataccaacagagataaaacaagagccctaatgccgtaatgatcgacaagcactcctccgaacaggggaccaatcattctgccgcctgtcgccgcactgttgacaaagccttgataaaagccttctttccctttaggggcaagctgattggcaatagtcggcacagcaggccaaacaagcatttctccaatagtcaggatcaccatcgcagcgagaaacatcggaaattgctttgcagtcagcagcatgctgaaagacacaataaaaatgataaagccgatgaccatttgcgcttttagcgactcggcccattttttcaccacaaaactgacgagcggctggccgagcacaatgagaattccgttaaccgtccacagcacgctgtataaggaaagagatattccaatgctttgtgtgtacgaagcaattgtggttgaccactgagaataagccagccatccgagtacatagcctccgcttaaaatgatcagtgcggcaaattttgctttgctgttcacagcatcgtaatcaagcacagacgtttgggacgcatctcccgtctgaatatttcgaaatccgaaatatacaataaagaaaaagaccagatacagcgcggcattcgccaaaaatacatatgaaaacgagaaagacgccacgacaccgccaagcgctgaaccgacagccacacctgcgttttgcgcgacatatatcgcattaaatgccttccttcccccttcaggccataccgatcctgccattgcgtagctggccggaaaaacaacaccggagccaaagcccacaatcgtcagcagcacaatataggctggccaatcatgaaaaaagacaaggcccatcaggcttgctaacgtaatggctatcccaagcataatcgatttaaaaccgccgattttatcaaacaaaaaacctccgcataaattgccagccacactggcgccggaattcagcatcaggacaagtccggctactgttaacgactttcctaaatgattatggatataaatcgtattcagcggccataaaaaagaagcacccgtcacattgataaacattccaatgactaaaattttaagagcacgcggcatactcatccccctttcttacctaaaaaagctcatgaaaaaaacgaaacctaaaacggctccgtacgaatccagttatcatagcacattcattctatctgtctctctcacatttttcaactgatgagcgtgaaaaaatctaacaaatattgtttgaaaaatgtaaaataaatagaaaaagggggcatattatggaaatggcattagcattcttaggttttctggcatgtctcattgcactgggctatggattatatcactttgtcagatatgtactgaaaaaggaaaaacgtttctccaagagacttttttggccgcttttcattggaggccttgtgctgctctttaccggagcagcattggcagaacctgacacttccgcagcaaatgccgagaaaaaatattcagcgctaaacgccgaatacaaaaacctcacaaaagagcatgaagaacttgagaaagaatataaatctgtcagctctgaagcaaaaaaattaaaagacaacaaagaagatcaagacaagcttgagaagcttaaaaacgaaaatagcgatctaaaaaagactcagaaatcattaaaagctgagattaaagagcttcaagaaaatcaaaagcagctcaaagaagatgcaaaaacgacaaaggctgaaaatgaaacactccgacaagataaaacaaagcttgaaaatcaattaaaagagacggaaagccaaaccgccagttctcatgaagacactggaagttcttcaaacaatacgagtaaaagtgatgaaaccaaaacagctgacaaagcagaaggctgtaatatcaaaggaagcaaaaacggcatctaccacacgccaggcagtacatactatgaccggacaaccgatccggctgaaatgttttgctcagttgaagaagctgaagccgccggttatcgggcgccaaaacgataaacaaaaagctccagtatgtctggagctttttctgtttcacaacgacgatttaatgaccttcttataataaagaactgacagaaaaccaaaaatggagtagagcgcagtatataacaccatcaccataatcatgggcgcccatatctctgatccgaataagaaccagccggattggacggcaaagtaactgtggaagagcccgacaacgagcggaatgccgaagttatacatttgtttgatgcgtattccctttattaggtcgccctgcgtaaagccgagttttcttaaaatcgtatagctcggtttttcatcttcactttcacccatttgtttaaaataaaggatacaacctgatgtaatcaggaacgttaaccctaaaaagccgacgatgaacatcaccataccaaacagtgatttttgcgcagcgcttgtatccaatcttgataaatgctcgtttttcttgttcacctgttgaaaaagctcatttgctttttccatttgatcttcatgtttcacattgacgccgataaatgtagattgcgccagctgaattcgggggtctttatccttgttcagctgtttaaacaggctgtcatccacaatgacagcgggcatgcccccgcttgtaaacgtgtaggatacaagaaactcttctcttaatcctttatattttaatggctgcgtctcatgtttgctttttactttaataacaccagagtccttgaaaaccattattttttgcagcaagtcggtgtatcctgagaaaacggcttctccagccgccacatcgactccttttacatctttgtcgctaacaacagcaagctgcatattgctgggatcgccctgcatctctttcggagttccatccataatatttgcaatgtcaacatttgcttgcaggacaggtgttgccttttttacaaacgagatgttgctttccctcaatttgttttcaaataacttggcatctttctcattcatgaatgaaaaatcagccgctacattttgttcagcggtcttttccgacgagtaatacgagatgtaagcaagagataacagcccgatggcgagcgctgaaacggttgtaataatcgtcagcagcagcgcattcgatttcattctgaacatgatcgatgacagtgacagaacctcagaaatatttaagtagccgcccttgctttttcgaatgatattcgagataaacgtaactgatcctttataaaacaaaaacgtcccgataatgacgctccccagaatgaagctcatcgcaacaaacagttcattaatggtcttaaattttccgccaaacagctcagaagacacatagtatcctgtcaaaatcaacacgatgcctaaagcgccgatcagcatttggaaaaatgatattttcttcactttgtcttcagtggaggacgttactttaaacaaagataaaatactctgttttttgataaacgtataattcatgatcatgatcaaaaggtaaatgccgcagaacacaatgaccgtttggaccaaggcctgctcagaaaaatgcagtttcgcatccgctttgacatcgacaattttgaacagaatcatcaagacaagcttcgatatcgaaaacccggccgctaccccgatcgctaatgaaccgaaatacagcatgacattttctgcacttaagatgcgaaaaattttatgcttcgtcattccaattaattgaaacagcccgatttctttactccgtctcttaataaaaatcgtattggcatataaaatgaagatcgccactacagccacaagcaaaatcgaagcggttttaatagccgcggctcccttgattgaagccttcacttcgttaattgctggatcatactgcagcgtgacaaaggcgaaataaagcgccacgctaaagatgagcgcaaacacatacaaatagtaattccggagattctttttcaaatttcgcaggatgagctgattaatgttcatgctgcaccccgcctaacacgccttgcgttttcataatatcctggaaaaacgtttgcctgtcctggccccctttattcagctgtgtatacatttgcccgtccttaataaaaatgactctgccgcagtagctggcagcgacgggatcatgggtaaccataataatcgtcgcgttgcgtttttgattgagctggctcagcttatttaatagatcggaggccgatttcgaatcgagcgcgccggtcggttcatcagcgaaaataatgctcgggtcatgaataaacgctcttccagcggatgttctctgcttctggccgccggaaatttcattcgggtatttatcccgcaattcatatattcccagttcctttgcaacttcctcaaacttgcgattggcttccttttttgatagtttcgtgatcgataaaggcagaaggatattctctttcactgtcaatgtgtctaacaaattgtaatcctgaaagataaagcccaaatgctgttttctaaattcagccagctgcttttccttcatagccgtcatgtcatttccattaatatgaatggttccgtgactgacctgatcgattgaggacagaacgttgagcaaagtggtttttcccgacccggaagcacccataatactgacgaattcgcccttttcaatgtgaatatcgatgcccttcagcacttcctgtttattcagcttgtttccataactttttcgaattttattcgcttctaaaatcaccatttacgcagtctcctttatattggataatctcattataaaaaggaatgccgggcttttccttcgatacggcgaacaaaaaagaaaagcatgtgacattttcgtcacacgcttatgacatgttcaaattgattccgtattggaaaggttaatgtaaaaactgttcccgcaccaaactccgactcaacatcaatatggatcaataacggcgccgctgctttttttgccaagtacagccccatgccagttgacgcttgatcatggtgatccgttgtggatgtaaaccctttatcaaaaatacgcggtacatcttttggatcaatgcccctgccacagtccttcacttggagctgcgtctgttcccctttttgaaaacttttgatctcgatttcagaggcttcgctgtatttcaccgcgtttgtcagcagctgcctgatgataaacgccagccattttgcatcgctcagcacttctttggcctcgagctgtatgtcaaaaccgatccctttttggatacaccacgattgcaaatctttgatttctttaaagatcaaaggctgaagctgaatgaattctacagacagatcgttttcaataaatgatatccgtttttgatgaagctgctgatcaagaagcagatgaatacgcagccattcatatgacagctgggatttcagtgctttttcttccattctatcaatgattaaatgcatcgctgttaatggagttttgacctcatggatccatgccatcagctcatctttttcattttccaatgctaagcgatgccgtgctgcggtctgcttcaagtgttctgtttgcccggcaatgcttctttcaaccattgcttcaaacggcgtttccggttcatttatggctgtcacatcgagattgttctcccatgttttcaagcttttataaaacgctgtttctttccgatagcggaaccaaaggaatatgataaaaaacaaaatgcacaaatacaccatataaagtacattcccaaatgatatggaaggatcgacaaaaacaatgaacagcatcaaagcctgctgaaacaaaaaagcggcaatccagctccgcctttcgataaggaatgctttaatcatagaacttgtcctcttccttcgcgatgtagccctggcccacctttgtctcgatatatgcaccaagctgcagggcgtccagtttttttcgcaggcgattgacattgacggtcagcgtattatcactaacaaaacgctcatcgttccacaagcttctgatcagctcttcccggctgacgatcttgtttttttgctctattaattgttttagaatgaacatttcatttttggtcagttcaacagatcctttgtcattgctgacgaggttctgctccgcgtctacagcagcgccgcaccacgttttaatcgtattcggctccgtattataatggtgcacacgccggaacatcgcttggattttcgcaatcagcacatcaaaatgaaatggcttttggataaagtcatctgccccgagctgcatggacatcaccatatcagcaggatgatcccgggaggataaaaagagaatcggaacatttgaccgggagcggatcagccggcaccaatgaaagccgtcaaatttaggcagctgtacatcaataatgacacaatcaggattaaccgccgcaaattcctgcagcacctgactgaaatcctgaatgccgtatacatcataggaccatcccgttaaacgatccttgatttcatgaaacagcgattcatcatcttcaatcagcaaaagtttaaacaatcaactcaccgcactttttccttttttatcaagtgtatagcaaaacgctatcatgcgctatagaaaaagccggctgtctcagccggctcgttcgcattatagttctcttctcaacgctgtcagcacgttggtttttgttgcttttctcgccgggttcattccggaaatgactgcgacccctccgcaaatcacaacggcaatgatcacaagactcgccgggatgtaggagaatgtgtaattcaagtcgcccgcatcgcttccgcttgtggccgcaagaatcatcggaacggccaggttgacaaggtagctcacgccgtaagaaatgataatcccaatcacacagcctaaaattccgatatacgcgctttccatcaagaacattcggcgaatgattgacgggctcgccccaatcgctttcataatgccgatctcttgcgttctctctgtcaccgccatcgtcatcgtgttaaaaatgccgatcgctgaaatgataactgcgatacatccgacaaagatcagtccgattttgaagaccatgaagaaggtattggctccctcaagttcagtagtcactgatgtgacatagtacccgtcatctgttagatcatttgtcagctgttccacattctcaaacttatcagcaaaaacaccaatgttcgtttcaacatttccgcctttgaaatctaagaattccgaaaaatcttttttgaattgatcactgataaaaatgtttgagtcctccatccagtcttgagatggtttttttgtaataccgacaattttaaagtcatatgtttttgtttttgtaacatcccctgttttaggatctgtcttcgatacacttagttctattgttttgttcagaatatctttcgtatagccctttggttcttttatatcttctggatttccttttgcttcttcgatttttttgttatattcttccgattcttttttcgtcaataatctctttgcgaagtcgtatcctactacgatttcattttccgactttgcgactcttcccttttccaattccatattggcctttaattcatcattcatattagtaaaaatgagatttgagctttcatttgtacgattgcctaaagtagctttgtttggttcatacacttgcgttctttctacaactgaccttacgtgatcatacttctctaaatcagcttttttaataggcttgtctccttccttgcccattacactgactttcgttacaatctgctggctcattgtcatatctgtaattgtcttttgaatcccaaatccaacggacgacaacacaaccaaaaacgcacacgccattgttgtcgccagaatcgtcataaagacgcgaagcctgtttttcttcatatttcttctgataaaatgaacctgatccttaaacctcaacggtaattcctccttttagcacaccatcatgaagctgaaattttgaatgtccgatagaagcgacttcatcatcgtgagtaatgatcacaaatgtaatgccacgctcacgattcagctgctggatcaattccagcacttcatgttccgtttctgaatcaaggcttcccgtcggctcatccgctaagataatcgaaggatttaaaatcaatgctcgagcaatactgacacgctgctgctggccgcctgacagttcattcggataatgagcggcgtggttttccagaccgacgcgtttcagcatgtcctgcaccttttgcttccgctcagatggcttgattccttttaacgccagcggcatttccacattctcatacgtcgttaaacccgggatgagctgaaagctctgaaaaataaacccgaaatggtcaagccgaaattgcgcccattccttttcattaaaccccgtaacatcagtgccattaatgacaatccgcccttttgtcggcgatatgtagccggaaattaaattcaaaagcgttgatttccctgagccgcttcgtccgacaatgcaggcgatttcccctttcgccacgctcaatgaaacatccttcaatactggaacttcattctcacggcccttttttccgatcgtgaaagaatggtcgatatgctgaacatcaatcatatgttctctctcccttacaaaagtttcattttttataaatcgcaaaataactaatcaagaaaccgattaccgcacctgtacccatgccaatgagataaccggcaaagctctcgcttgcagtaaatccaaaatagccgaagcccatgattcctatgataataacgatgatctgcaccgggcggttaagcggcttccataagaagaaatatccgtttctttcattagacattttaacaaagctaatatagccgatgatgtaaaaaatgatagtcatgatagccggaatgactaaataatatggtgaattctcagcccatttcgagtctacataaattatcggaatgaaatactgcacccatttaggtactggaccatggataaaatctattgatccgccaaaaaggatctcgaggttgatcgcaggcaggctgatgagcaaaaatggcgaaatggccacggtaaatgagactagaagctgtgcgaaactattgcctgtcaaagctccacccgccataacaagcgaataagccagcatgctgacaatgatcattccaaggctgtaattgtgaaaataaacggcctgatcaggcttcaaaagtatgatcagcaaaacagataaaacataacctatgagctgcggtatcacaatcaccattccgccagtaaggaacttcgcatgaaatatctgccctcttgtatacggaaggcttaatgtaaaatcaaaaaagcccttgcttcgttcaatccctagctggctgaccgccaaaacgactccccaaatccaaaacaatgagataaatgagctgtttaaataatcaacgctgaatacgcaggggccgacccaattttcttttccagtgacacagccttgatagatgagatacatatttaaaattgataatggattacccaatataaaaaccaaaatggtgataactaaggcgactttattctgccgccactctttgtaaagcagtccggaatccggcaactcacttccctccaaacctatggcatttcttacacttttgttttcttataaatagagaagtagctcacaaagaatccagccactgccccaatgatcatacccaaaatataaccaataatggaatgtccggtatagtatccaaataaaccaaatccaaggatgccgaaagccataaccagaatttgcaccggacggtctaatctgttccataagaaaaagtgtccgtttcgttcacttggaagcttcttgaagcttataaagccaatcaagtaaaatagcatgctcattacggctggaatcaataaaagatatttactgttaatcagccattcatttacaacgtaactaatcggtactaggttcgataaattgcttgccagagagaaataactctcaggggaagggaatatttcccatatattcgcaccaaaaacaacttctaggtttccaaccggcaatgcaataattaaatacggcaatatagctgctgaaaacgccgttaacagttgggcaaaagcatttccagttaacgctccggcggccatcaccagtgaaaaagccataaaacttatcacgattactccaatgctgctgtgctcaaaaaagtagacgtgttcagggttatagacaagaatcagcagccatgcaagtaaaaagccaatcaattgtgacagcacaatcacaaaaccgcctaaccaaaattttgtctgaaaaatttggcttctgttatacgggaggcttaatataaaatccatcgtgcctttcgaacgctccattccgaggaagcagaccgccaaaatgacacccggcacccagttgatatctatcagattgcttatggaataattcacaataaaatcacaatattgcgggtcttggcgatcaagacacccttgataagacaaatacgtattaacgatagaaagcggatttgccaatactaaaaacgcgatacttaacaaaatcaccacttgattctgcttccactctcgatagaggagacctcggtctaccatctccgcttccctccaaacttcgcaatgaacacttcttccaggttgacaggaagctcattccacacttttggcttcagctctctcaaaaagctctttttctcctcatcgcttttcggaatcagcactgtgtaaaacacgccggcctgatcgagcatcggaatgttttgctctctgatggccaaattgacatctgtatcgaaggccatttgaattttaatgtattcttcttttaactcatcaagatccatgacgttggtcaggctgttatcttcaagaaaaccaattcggttgcacatccgctctatgtcttcaagccggtgggacgtaatcaggatgctcgtatcacgctctgccacttcatcgaccatcagctgcagcacatcatgccttgtcaccgcatcaataccatccgtcggctcatcaaggaggatcagcgccggtctcgccgcaaacgacagaacgagcgatagctgcttttttaagcctgtcgacagctcacggtattttttcgtttccggaatttcgtatctgttcatcagctcattcgcgtacgtgacatcaaatttcggatatattcttctcaaaatatcgactaactgcttgtatgtatacttatcgtaaaacggattttgaacaggcatgtagatgatattttgtttgactttcgggtgctttttgatttctacgccgtcaaataaaatcgttccgctgtcagcgaaaatgatttgctggattaagcgaagcatcgtcgttttgcccgatccattgcgtccaagcaatccaaagatttctcctttttcgattgttaatgaaacatcttttaatacttgattgccgtcaatcgcttttgacagctgccgcagttcaatcattttttttgcctcccttcacatcagcgctgatttcctttatccattcgtgcagtttttccagctcaacccctgcatagtgtgcatcgatgatgagctgtttgagttgctctttaatcatcgtcatcttcccttcaaccagtgtcgtttttgcattctccgatatataggtccctctgccccgcagcgtttcaataatcccctctcgctcaagttctttatacgctttgctgacagtgttcggattcgcaataatgatcgttgccaattctctgacagaaggaagcttatcaccaggcttcatgatccctttcaaacaaagctctttcatttgctgaataatttgttcgtaaatgggtgttgagcttcttggatcgatttgaatcatttacttccctactttctatacgatctgaaccttttatagataaaaatgatcaattatacttttttgccattcaaaaccgatcatcacaagaacaagaaaaaaagaacaagcgatcacagatgccgcaatcagcattggcacgttacgtttgtttcgttttttatgtttcataactgcctcccttaatgtcaatatataaatgattttatattagtgtctatagtgtattacttcaattagtacacttaatacaataaatactttgactcacaaagtcaatcctttttttacaaaaaaacggacccttttaaaagggtccgttttcctacacatcaagagggtgctgcaggatcatattattttgcaaagattgaagctgaagtctcattctgtacagctgttctctctgctgatcatttgacgacagccatagtttattcaaggcatttaccgcatcttctagctgcatttgtgcatcactatattcttgatcgttataatgctcttgtttagaagcgattttcagctgttcttcagcataatcataggcctgcatacattgctggagatgttcatctactgattgtcttgttgccacagtaacccctcctcttggtaatggaaatcatccatcattcatattgtagcctcatctgactttattcaataaagtaatttatggtcgatattcatttgttctcttgtgaaatgcgtgctacaattttaggatgcaatcgtacgcaaggaggcacatgaattgtgatacagaacaatccttttccttattcaaatacggaaaaacgctatcatacattgaattatcatctcagagatcatttcggccataaggtgtttaaagtggcgcttgacggcggctttgactgcccaaatcgggatggcaccgttgcccacggaggctgtacgttttgcagcgcagcaggctccggcgattttgccgggaaccgggccgatgatttaattacgcaattccacgacatcaaaaaccgcatgcacgaaaaatggaaggacggcaaatacatcgcttattttcaggctttcacaaacactcacgccccggttggggtgcttcgcgaaaaattcgaatcagtgctagcgcttgatgatgtggttggcatttcgatcgccactcgcccggactgtctgcctgatgatgtcgttgattacctggcagagctgaatgaacgcacctatttgtgggtggagcttgggcttcaaacagttcatgaacggactgcacttctgatcaaccgcgcacatgattttaactgctatgtggaaggcgtcaataaattaagaaaacacggcatacgtgtctgctcgcatattatcaatgggctgcctttggaagaccgggacatgatgatggaaacggcaaaggccgtcgcagatttggatgtccagggcattaaaatccatctgcttcacctactgaaaggcacgccaatggtcaagcaatatgaaaaggggaagctggaatttctttctcaagatgattatgtgcagctcgtctgcgatcagcttgagatcattccgcctgaaatgatcgtccaccgcattacaggtgacggaccgattgagttgatgatcgggccaatgtggagcgtcaacaaatgggaagtgcttggcgccattaataaagagctagaaaatcgaggcagctatcaaggaaagttctttcagcggcttgaggaggaatcagcgctatgattttgaagaaaattcttccctacagcaaagaactgctgaaaatggccgcgggagaaggagatattgtcgtagatgcgacaatgggcaacggacatgatacacagtttttagcggagcttgttggtgaaaacggtcatgtgtacgcattcgacatccaagaatcagccgtggccaatacaaaggaacggctcggtgacatgtatcaagcgcgaacaacgttatttcacaaaagccatgataaaatcgctgaatccctcccgcctgaaacacatggcaaagtggcggccgcggtatttaacctcggctatttgccgggcggggacaagtcaattacgacaaacggcagttctacgatcaaagcaattgaacagcttctcggcatcatgaaagacgaaggtctgattgttctcgtcgtctatcatggccacccggaaggcaaagctgaaaaaaacgacgtgctcgagttttgccgggacttggaccagcaaacagcccgtgtattatcatacggatttatcaatcagcaaaatgacccgccatttattatcgccatcgaaaaaaaagctcagatcagcaaatgatttgagcttttttctttgagtttttcatccagaacattttttgaaatttccggtaggctctgccgttgatataaaagaaaagggaggtttttccgctggctttgatcagcttctttgcgagccggcccatttccttttggcccgccactttatcatctgacaaataaacgccaagcaagccgcgattgattaaacgatggaagttttcatgcggaatgccttgtaaatgctcgtcagctttatggataaagtgttcaagccgattcatcatctcttcatgagactgataatacgagcagaaattcaagtctccttccagcaagtcctcctcttgatcaatcaaataatcaagaagaatatgaaggccctgtatgtaaggaaaataactgtcgcggatttttttagcggtgctttctgtgaaatcaggctggaacgaatacgcaaccagacagaaaatgcctaacgttgagcctgcacaggctgaaaattcataccattccatctcaggcagctctgattcatattgagtaaaccacttttcaagccgcggaacacgctcatgctcaataacgtgcttatgcacctgcaaatcgcaataatagccgcacagttcaagcagataaggtttaatcatgtcatagtgctcaatggagccgagaacacgctggcacgttttgaccagttcatgcaaatatccgctgtcatcctgttcttccctgaattgataatagttttgcagttccgccccaactgtcagtgcgtcctgcattgaggcatggagcatccgaaaatcctgcgggtccagcgaggtgctgcggtcacacagattgtccaaataatcactaatcgtttgatacgcgatgataaactcgacacatttctgtttttggctgcctgacaataaggccagtatgccgccgccttcacagtgaaacgttttgtcccgaatacttgcggttgcctgtgctttcaattcactgttatgaatcgattctgatttttgcttccatatgtccagctcttgatgaacgagcggaaaaatatctcgatatacctttgccatcaatccaaaaggatgttccggtactgtcaacacatgcaccccctactagttcaaatatattgatcagtaaacgctcttgctgctttaaaaacatcttctctctcgggttcattgaagatctcatggtaaagcccttcccactctctgtatgctttattataagaagcaacaccattaaaccacttgatgaccatcgttttgtcaacaagcttgtcatcaccggcttgcatcacaagaagcggaactttcaaaaatgcctctgtcggcaccattgccgattcaattgtctttaaaagctctctgtaccatctgacagaaactttcctgacgtataacgaatcattttggtcagcctcaatgacgtcctcattgcgcgtcgccatatcaattgataatcccgaatcaaccttaagtgacggagcgatgacattcaggccttttgatgcaagatcaagcgctttattcactttaatttgcagtccgagacacggtgatgataaaataattcccgtaatcttgggatttctttgctgtttaatccattcaatcgcgaccagaccgcccatgctgtgacctagaagaaaaaccggcagatcaaaggttcgcgctttatctatccaagcatctacttcatcaatgtattcttgaaacgagcgaatatgccctctcgctcttgtcgttgttccctgtccaggcaaatcgcccatgacaacgtgataacccgaagaccgccacatttcaatcagccatttatatcgtccatgatattcacttgccccgtgaatgattacaatcacggcaacaggtctgtctgctttccaggtccacatgatcttcacctcatacgaaatttaaatagagaaagaaggatgaatcttatgatctacccttataaggaacacaagccagatatccacccaacagcctttatagctgataatgcaacaattaccggtgatgtcgttatcggagaacagtccagtatttggttttctgttgtcataaggggagatgttgcgccgaccagaatcggaaacagagtcaatatccaggatttaagctgcctccatcaaagcccgaacaagacgctgctcattgaagatgacgccacgataggccatcaggttacacttcatagcgctgttatccgcaagaacgccttaatcggcatgggctcaatcattttagacggagccgaaattggcgaaggcgcttttattggtgccggcagtcttgtcccgcccggaaaaatcattccgcctggccatctcgcctttggccgccctgcaaaagtcatccgccctttgacggaagaagaccgaaaagatatgcaaagaatacggtcagaatatgtagaaaagggccaatattataaatttcttcaacaaacataagacctgcttcgtcttactttaccatttttcaaattatatttgaaagcaataaccatcgttaacccggacgtcataacagttcgggtttcgatttttccataaaacgttcacatatagcatgaaacgtatgacttttatcttatcacaaaactataaacagcctctgcaaaaacacatacctattctttcctgttctctattttctatgagcacacacaaaaagagcccactgggagctctttttgtcagctgatatttcgttcgctggcagctgctgcattttttttgtgaaacccttttccatagtacacagccagcaagatgagaaaccatatcggcccgataatcacggctactcttgtatcaggactgtaagccataagaatgacaacgaatgctagaaatgccaatgacacataagacgtaaacggaaataaaggcattttgtactttaattgtttcttttcttcaggcttcaaacttttcctgtattttatttgagaaagcaaaatgattgcccacgtccaaatcgctccgaacgtcgcaatacttgtaacccaagtaaataccttcgcagggacaacatagtttaacagcactccgactaataaagcgcccgctgaagccagaacagctttacccgggatgccgcctttcgtcagctgaccatatgcttgtggcgcctctttctgttccgccaagttaaacagcatccgccctgtgctgaaaataccgctgttgcatgaagacagcgcggctgtcaacacgacaaagttaatgatacctgcggccgatggaatgcccactttttgaaatgtgagaacaaatggacttccttgagagccaatttcctgccacggataaatagacataatgacaaataaagcgcctacataaaaaatcaaaatccgccaaaatactgtatcgattgctttggctaacgatttttgcgggttttttacttcgccagccgtcaccccgatcatttcaatccctaaataggcgaacatgaccatttgaagagacaatagaaccccttttaaaccatgagggaaaaatcctccgttgttccacaaattgctgattccggttgcaatgcccccattgccgactcctgcaataatcatcaataaaccgacagcaatcatggataagatcgcaacaattttaatcaatgcgaaccaaaattccagctcaccgtaagctttgacagccaggaaattaacacccgtcataatgaccagtgccgataatgcccaaatccagtttggcacgtcaggaaaccagaaccccatatagatgccgacagcagtaatttcggccatacaggtgacaacccataaaaaccagtagttccaccctgttaaatagcctgcaagcggtcccaaataatcacgcgcatacctgctgaaggagcctgcgaccggtttttgaatggccatttccccaagcgctctcataataaaaaacatgaccaggccgcttgcggcatacgctaccaaaataccaggccctgctaattgaatagctgatgcggagccgaggaacaaccctactcctattgcagctcctaaagacattaaagaaatatgcctttcttcgagtccgcggtgcagctcttgtttttgtttttgcatgctttcttctcccctagaaaaaaattcattaaatcatttttctgaatatttcgtatgaattgggtaaaccaatgatgatggagaaataaaaggataacaacaaggctttcgactactcgaaagccttgttgtctgttacacaaagatgacttctttaggctgatggctcagctcttcaggcatataccgtttttcaatattgatgctgtgccagatcataaagattagcacagtccagattttacggctgttatcagccttgtccgcacaatggtcttcaagaagctgaaggacataatccttatggatataagcatccgtttggctttcctgaataatattccgcacccattcgttcatttcgtttttcagccaatgacggatcggtacagggaaaccaagctttttgcggtttaatacgtgctcaggcacaattccttcagcggctttgcgaagaagatacttcgtcgtgccgttcttcgttttcagctcatcaggaatttttgaagcgacgtcgaatacgactttatccaagaacggcacacgcagttccaaagaattcgccatcgtcattttatccgcctttaacaaaatgtcgccgcgcatccaagtgtggatatcgacatactgcattttgttgatatcgctgtacgagctgctttctgtaaagtaagtcttcgtcacatcgcgatatgaaaggttcggattataatgcttcaacagctgctttttgacagactcttcaaagattttagcgttaccgatataacgatcctgaagcggagtgcagccgcgctcaagcaggctcttccctctcataccttcaggcataacggcagcaacgtgcagaagcatctttttcaagccggacggaatccgttcaaacggtttaagcgaaagcggttcacggtaaatgttatatccgccgaagagctcatccgctccttcacctgataaagcaaccgttacatgttttttcgcttcttttgcaacaaagtacaacggaatcgctgccggatcagcaagcgggtcatcaaaatgccatacgatcttcggaagctcattcatgtattcctcaggcgaaatgactttgctgatattttcaatgcccagcgccgctgccgtttctttcgctacatcaacctcactgaagccctgctgttcaaagccgacagagaatgtttttaagcttggatgaaattccttcgcaacagacacaataaaggaagaatcaatcccgccagacaggaacgaaccgacaggaacgtcacttctcatatgaacgtttacagagtcatagatcgcgtctcggacttctttcacaagcttgtcttcttcagtctgaaccggcttgaagttcgctttgaaatacgttttgaatgtgatatcgccgtccgggcggattgtgaactgtgaacccggctctacttttttcacatgggcatcaagcgtgcttggttcaggaacaaattggaaagacatgtactgctgcaatgcctctttatctatttcaatatcattctgagcaaccattaaactttttctctctgaggcaaaataaacctgatcattgatcgttgtgtagtacaacggtttaatgccgaatggatctcttgccccataaagcacatgatcgtttttattccaaatcagaaaggcaaacataccgcgcagtttggacgccgcttcttctttatagtgacagtaagtcgcaagaagaacctctgtgtccgaatccgtgttgaatgtgtacccctttgcttcaagctcttctctcagttcaatatagttatagatttctccgttaaagataatccaatatgtttcatcttcatatgataaaggctgtccgccattttctacatcaataatgctgagccgtctgaatccgaagccgacgtgctcatcatggaaatatccatcactgtcaggaccgcggtgaacgatcatttggttcatttgtttgattagttcttcttgatcagcggtttgagctaacggatgcttgttaaaaaccccgacaaatccacacatagtattgcctccataattaaaattgtcatcattgaacccctatttatagacgctgtgaataatatttggtttcacagttatgtaaaaaaataaacatgaatacaacgataaaaaagggaaagccgcttaaccagtaagcggctataaaattattctcctaacgcttctttacgcagctgctccgctttgtctgtacgctcccaaggaaggtcaacatcgtgacgtccaaagtggccgtacgcagcagtttgtttgtagatcggacggcgcaaatcaagcattttgataatgccggcaggtcgtaaatcaaagttattgcgaacaacttcaatcagtttttcctcagaagcttttcctgaaccgaatgtgttgattgagattgacacaggctgtgcaacaccgatcgcgtaagcaagctgtacttcgcaagaatcagcaagctcagccgcaacgatgtttttcgcaacgtatcttgccgcataagctgcagaacggtctaccttcgtcgcgtccttacctgagaacgcgcctccgccgtggcgtgcatagccgccgtacgtatcaacgatgattttgcgtcctgtaagtcccgcatccccttgagggcctccgattacgaaacgtcctgtagggttgatgaaatattttgtttcttcatcaatcagctcttcaggaacaaccggattgattacatgttctttaatgttgcgctgaatttgctcaagtgtaatttcagggtgatgctgagttgaaataacaatcgcgtcaatgcggactggtttgttattttcatcgtactcaaccgttacctgtgttttgccgtcagggcgaaggtacggaagaatatcttctttacggacttcacttaggcggcgggctaatttatgggcaagtgaaattggaagaggcataagctctttcgtttcgttgcacgcataaccgaacattaatccttggtcacccgcaccaatcgcttcaatttcttcgtcgctcattgtgccttcacgggcttcaagcgcttggtctacgcccatcgcgatatcagcagactgctcatcaattgatgttaaaaccgcacaagtttccgcatcaaatccgtattttgcacgtgtgtatccgatttctttaatggtttggcgaaccgttttcggaatgtcaacatacgtagaagttgtgatctctccgcttacaagaaccaaacctgttgtcacagatgtttcacaagcaacacgcgcgttagggtctttctttaaaatttcatctaaaatgctgtcagaaatctggtcacagattttatccggatgcccctccgtaacagattctgatgtaaataaacgacgatttttactcatgatttgcttcctcctgcacaaggcctcccgaaagaccttgtatatatgatacggaactcgctccctcttatacaatgtacagttatattagagaatgttaattggcatatttatgaaataaaaaaaccttttccatcgaggaaagggtttggtctttgtgcctttcactcttatcgctcaaggaatcatacaaccttgcaacaggttagcaccttggttgtctcactcagttgaacataataaataacagagaaaccggttgctgggcttcatagggcctgtccctccgccagctcgggataagagtatccgctcaatgaaatatcttatcgtaaaagggtttgcaatgtcaatatgattcagaagaaataggcacctatattgagggaaaacaatggaaatgcacacacaaaaaacaataaatagtatagactatttgaaaatatatgttatactaattcacaattagcaaaacacaaaaaacgataaaggaaggtttcatatgaactcagttgatttgaccgctgatttacaagccttattaacatgtccaaatgtgcgtcataatttatcagcagcacagctaacagaaaaagtcctctcccgaaacgaaggcattttaacatccacaggtgctgttcgcgcgacaacaggcgcttacacaggacgctcacctaaagataaattcatcgtggaggaagaaagcacgaaaaataagatcgattggggcccggtgaatcagccgatttcagaggaagcgtttgagcggctgtacacgaaagttgtcagctatttaaaggagcgagatgaactgtttgttttcgaaggatttgccggagcagacgagaaatacaggctgccgatcactgtcgtaaatgagttcgcatggcacaatttatttgcgcggcagctgtttatccgtccggaaggaaatgataagaaaacagttgagcagccgttcaccattctttctgctccgcacttcaaagcggatccaaaaacagacggcactcattccgaaacgtttattattgtctctttcgaaaagcggacgatcttaatcggcggaactgagtatgccggtgaaatgaagaagtccattttctccattatgaatttcctgctgcctgaaagagatattttatctatgcactgctccgccaatgtcggtgaaaaaggcgatgtcgcccttttcttcggactgtcaggaacaggcaagaccaccttgtcggcagatgctgaccgcaagctgatcggtgacgatgaacatggctggtctgatacaggcgtctttaatattgaaggcggatgctacgctaagtgcattcatttaagcgaggaaaaggaaccgcaaatctttaacgcgatccgtttcgggtctgttctcgaaaatgtcgttgttgacgaagatacacgcgaagccaattatgatgattccttctatactgaaaacacgcgggcagcttacccgattcatatgattgacaacatcgtgactccaagcatggccggccatccgtcagcaattgtatttttgacggctgatgccttcggagtcctgccgccgatcagcaaactaacgaaggagcaggccatgtaccatttcttgagcggttacacgagtaagcttgccggaaccgaacgtggtgtaacgtctcctgaaacgactttctctacatgcttcggctcacctttcctgccgcttcctgctcacgtctatgctgaaatgctcggcaaaaagatcgatgaacacggcgcagacgttttcttagtcaataccggctggaccgggggcggctacggcacaggcgaacgaatgaagctttcttacactagagcaatggtcaaagcagcgattgaaggcaaattagaggatgctgaaatgataacagacgatattttcggcctgcacattccggcacatgttcctggcgttcctgatcatattcttcagcctgaaaacacgtggaccaacaaggaagaatacaaagaaaaagcagtctaccttgcaaatgaattcaaagagaactttaaaaagttcgcacataccgatgccatcgcccaggcaggcggccctctcgtataaaaaacaaaagccaagagcaattatgctcttggcttgttttaattgacggaatgcaaagaagtcagcttgtatgtaatgatggtccggccttcttcccattgaagcttctgcacttcagctgtgcctgacttttcgccaaactttgttttgcgtacatccattggaatctccatcggatatactcggtatccgtccttctctaacgtgaatatattttcatctatgcgaacttcttttccttttgtcacaatcagtgtattaaattcaacaggcattcccaaagtgaaatcccctttcgttctcttttttctttatcataacatatttcactgtcagcggtttttcatccattgtgtgagctgccgcacgatacgccggttttcttttggcgggaaataatgtgtgaatgtactgtagtaccacgtctccaccggcttatgcagttgttttagcttctcttcaaataaataggaatgctgaattgaaacattttggtctttttctccatggattaacagcacgggagcctgaattttgtttacttggtcaaacggtgtcctccattgatattcctcaggcacctttttcggtgttccgccgatgactcttttcatcattcgccgcaaatcctgccgctcctcgtatgtaagaatcatatcactgacgcctccccaggaaacaaatgaagctgcctgcccgcccatttcgatcgcagtgagcattcccataattccgccgcgggaaaaaccgaagatgtggattctatccttcttgacatttgggtgctgctgaagcaggcgaaaagcagaaaatgcatcctccctgtcttctcctgcaaaatcctcattgccttctcctccttgatttcctctgtaaaaaggagcaaacaccacaaacccttgggatgcaaactggataatccggcccggccgaaccatgcccacgcttttaatcccgccgcgcaaatataaaaatccgtcatattgtcccggttccgccggctcagccagaagccccttaacccgtaatccatttgacagatagcagatcgtatacaaacgcacatgctggcttggcgacggaaatcttcttttctctacaatcaaaacagccgcctcctttttttctatatgctttccttactccaaaattacatccggagaacctggttaggcattcacacatttttatac

SEQ ID NO: 15 - DNA, 1089676 bp, Bacillus subtilis
ccatcatacgatatgtaaagcaaaaaaggatattaacttgatgcgaaataaggaggttgtctatgtgaacagatggttaaggctgagcttcgcctgtgtcggcagtatctttctgatgttcgccctggcggcttgcaagcaggaagaaacgctcacaaaagtcaaggtcgctgaagtgacccattcaattttttacgcacctttatatgttgctgagtctaaagggttttttaaagaagaagggcttgatgtcgatgtgaatacgacctggggcggagataaaacgatgacatcgcttctttccaacggctccgacatcgcgcttgtcgggtcagaaacatctatttatgtcgaagcgcaaggggctaaagatcccgtcattaatttcgcccagctgactcagacagacggaacgtttcttgtcgcgagagaagatgttgaacacttcgactgggatcagctgaaaggaaaaacgtttctcggtcagcgaaaaggcggcatgccgcaaatggtcggcgagtatgtactgaacaaacataagattgacccgcgtaaggatatagacctcatccagaacatagacttcgccaatattgccaatgcgtttgcttctggaaccggtgagtatgtacagctctttgaaccgcaggcttctctctttgagaaaaaaggcatcggccatatcgtggcttcattcggagaagaatcaggagaggttccttatacgacttttatggcgaaacaaagctatttgaagaaaaatgaagacacagccgtcaagtttacaaaggccatttataaggcgcagcagtgggttgaaaatcattctgcgaaggacatcacagatgccattaaagatgaatttgatgataccgacccagacgtcatcgaaacatccattgaacgctataaaaaacagcattcatattcgccagaccctctgcttaacgaaaaagaatgggagcttctccaaaccattatggatcaatcgggagaactgccgaagcacattccatacaatcagcttgtaaataaagaaattgctgaaaaagtcacctcggagaaataggaggcgccatctatgtctttcttacatgtcgaccatgtaacccatacttatttttctattaaagaaaaaacaacggctgtgcgggatattcatttcgatgccgaaaaaggcgatttcatctcatttctcggcccaagcggctgcggaaaaacaacactgctttccattattgccggtttgattgagccatcagaaggcagagttctgattgaaggccgtgagccgaatcaaaaagaacataatattggctatatgcttcagcaggattacttatttccctggaaatctatcgaggaaaatgtgcttctcggtttaaaaatcgccgacacgctgacagaagaaagcaaagccgctgcactcggtctattgccggagttcggcctcatagatgtggagaaaaaatatccgaaagagctgtcaggcgggatgcgccagcgggctgcgcttgcaagaacacttgcgcctaaccctagtctgcttttgctggatgagccattttccgcgcttgattttcagacaaagctgtctttggaaaacctggtattccgcacattaaaggaatatcaaaaaacagcagtgcttgtcactcatgatataggggaagcgatagcgatgagcgatacgatctttttattttcaaatcagccgggcaccatccatcagatttttaccattcctaaggaattggccgcaatgttgccttttgacgcccgtcaggaaccttccttccagacactgtttcaaacgatatggaaggagctgaattctcttgagaaacagcaaagaaaccattgatctgcttcacgagcagtatcaattcaaacagaaaaaggaaaagtggaaggtccattcctttcagcttgccatatttattctctttttctcgggctgggaaacctccagcaggcagggctggatcgatccgctgatcttcagctctccatcagctgtgtggcgattattgctggagaaacttggtgacggttctttactgtcacacatcggcgtcactttatttgaaacggtgcttggctttttgcttgggacgtttatgggcacgtgcctcgccgctttgttatggtggtctaaccgacttgccagaattttagatccgtaccttgtgattttgaatgcaatgccgaaagtagccctgggcccgatcctgattgtcgcgctcggtcccagttttatcagcatcattgcgatgggagccatcatcagcgtcattatcacaaccatcgttgtctataccgccttccaggaggtcgacgaaaactatacgaaagtcatgaaaacattcggcgcaaaaaagtgggttatttttaaagaagtcatactgcctgcatcctcccccgcgattatttcaacactaaaagtgaacgtcggtttatcatgggttggcgtcattgtaggggaattcctcgtttcgaaggtcggattaggatatatgattatttacggattccaagtcttcaattttacactcgtcttcttaagcctgctgatcatcgccatcttcgccactctgatgtatcagggcgtcgagctgctggaaaagaaatggacgaaggggaggacataaaaaacccggcacatgtgccgggttttttattcaatccatccagattctttcagttttttcaaactgatcggaagtacggaatccttcataataaagctgaattttttattgcgggaaaggttctccggaagctcgtgaaacaaaaccgggcctttcgtttcaaagtaatcagcttgcttttcaagcttttctatatctgcaaaatatatatttttcacaatcactttttcttttccgagaactttatactgtccgagatacttgaggcttttgactctcgcgcccgtctcttcctttacttcccggagcgcagcctcttctgcgcactccatcggctctactttcccgcctggaaactcatagcctctgtcctcatgttctgttaaaagccatttgccgccaaaacggcaaatcacccagacatgcttcgggctgtccgagaaaggctgatcgtcaaaggaaagctgaacagtattctgataataatctttaaactcgtacatgtttatccctcaaatccgttcctagctatcttccatacatcataccacagttacgtttcttcggaagccttttatcaaaaaataagggaaacccagcacgccgtcaggttctgcatgcagactagctcgtacagtttttttgcgatagcttttgccgaaaagtgcgaccgacgctctgggctttattatgacccgcgaacagggaaaagttacggtttgcgcttaaatttattttttaacgtttctaaaagatcgacaagcatctgaggaaccggtatgccaagagaactggctgtcacaacaatttgcacagattcataaagaatataaaacataatagccaagtcacgaattgatccctctgtattcagcagctgatcaaaaaagtggcatacagagatcagagccagcgtgactaattttttgacaagccgggcaaatacctttttaaatgacagtttgtgaataatggtttccttcaaagtcgtactgataaattcaattgccataagagagagcaaaatcagaaatgaatactgaaaacctccaaagaaaaaacccgctgctgaaacgctgactgctattaacgaaaagatgccaaagtctctatccatttatcccaacatcctttcacagaaacggccttacgatattctatggaaaacaagccgaacggattggatttttcagaaaaatggactggttgtcgcctatttttcagatacaaaaagaaaagccggacgtcttttttaagacatccggccgttctttttttggacttaacctaggtaagcttttagcatccagttatgtttttcaatattttgatggatcgcaagaagcatgtcccctgttgtttcgtcaccgacttcatcagctaaatccatgccgtttttcagctcttccgcgatgactgtgaaatcatcatatacgctttgaaccatttgttcagctgtttcatttccagccgcttctttgacagaagccgtttctaaggattccttcattgttgcaatcggttttccgttcagcgccaaaagacgttctgctaagtcatcaatataagttgccgtttcgttgtacagctcctcaaacttttcatgaagagtgaagaaatcttttcctttcacataccagtgatagttatgtagtttcacatacatgaccgtccagttggctacttgtttgttcactgcttgaatcaattgttctgacatggtatctcctccttgttatatgactatgtatacccttaatatcgtacgctaaaacctcttttttacccttatctgtcacgatttcttctattatgctacaattgttaaaaaacgggaggtggaatgtcatgacgcttctcattacgataagtattttgattgtgctggctgttttgcttgtaaccatttggacgactgtaaaagcctataatgtaaagcataccattgatccaccacaagaaaatcactctgattcacacaatcaatgatgatgtgaatgttcctcttctgactgattgctggcagcatcggcgtctccgacttggacttttaaggtcggcatgctatgctgtttttttgctgtgacatgggattggacagtgtatacaccatcttccttaaacgtcgtttccaatcggtatacgcctttttcttgtttcgccttaaacatttggcttgcgtctttttccccttctttccatacttcaaactctacttcatcggcatccgtcacagcttcatcaccatatgatacggctgcttcataagcagcgctttctccgggatttactttttcaggcccggtcagcttgacatccaaaacctcgggcgtctcagctgtatttgctttgctttcaccagatccgcatccattaagcaataaagcagaaaaaagcagaacaaccaacatctttttcatgccatcaccctttcatcgtttacctaaatagtagcaaacgcttacagcaaatggtacataaaatatgagacgtcacaaaaaagacctttttgcttatgcgcaaaaaggtcctttctattttagccaaatacttttagcaattcttctttatcctgtgaaagccagaaacgcattaaacgtttagcgccttccagatcatgaagcttcgcttggccgcactgcttttcattcgcagctggtatttctgtaatctctaccgcttccttcattgtgtcttcaagtagatcaacgatttccgctgatgtcggctctccgctcacaactagataatagcctgtctggcagcccattggagaaatatcaatgatatcaaaatgatcgtatttctcagcgtgagaacgaatcgtaaacgcgagcaaatgctcgagtgtgtgaatggtgtcaggcttcatcgcctgtttatttggctggcaaaaacgaatgtcaaatttatttacaacgccgtctgttcctactttatgcacgccgcaatgtcttacatatggagcaacaaccgcattatgatcaagctcaaaactttctactgaaggcataatggcactctccccttttttaaaaatgtaatttcattataacatacttttccgataagaattattgattaacttttcaatctgtgttttttttcttatacttgcatcagaaaggttgctgaagaaacatgaaaaccctattcatcgctctgatcagaggatatcaaaaattcatctcgcccctgacaccgccaacgtgccgcttttatccgacctgttcccaatatggaatcgaagcgattaaaacacatggcgctttaaaaggcggatggctgacaatcaaacggattttgaaatgccacccgttccatccgggaggagtcgatcccgttcctgaaaagaaacaaaaacattaattgttataaccgtttacgataagatccagttttccggttttaggatcaatgactaagccatggaccggaacgttttcagggaacagcgggtgatgtttaataacgtctacgctgtctttcacactcgcttccactgaatcaaagcttttaaaccattgatcaaagtctacaccggagtactttattgtttcgatgcgttcttccggaatccctcttgctttgattttttcaagcatgcttttgctgctgattttgctcatgccgcaatcgtgatgcccgatcacacacacctcatctgcattcagctcgtacactgcgacgagtaaacttctcatgatgcttccgaatgggtgtgtcacaagcgcaccggcacttttaatgattttcacatcaccgtttcgcaaattcatcgcatgcggcagcagttcaaccagacgagtgtccatgcaagaaagaatcgccatttttttatctggaaattttgatgtttgatacttttcatactctctttgttcagtaaatgtcttgttaaattcgagaatatcatttagaagactcatgttcgttgtccctttctattctttttactcttcaatatatcacaacccttgtttattcgtcataataaaaaaagacaaaccctctggtctgccttatttccccatgttatagcgttttttgaactgctcaactcgtccgcctttttcattgaatttctggcggccagtataaaacggatgcgtgtcagagcttacttctactttaatgacaggatatgtgtttccgtcttcccactctgctgtttcattagatgttttcgtagaggtgctgagaaaacggtagccgctgttgacatcctgaaatatcactttgtggttcttcggatgaattccttctttcatgtgaatctcctttcaataaatcgtaataattacgttttattctataaccttacaaacgttttgtcaatcttcttatatccttccctctgttttcacatcgtaaacctcatggcatttaagaataggaagaataatctaaccgaggaagcaaataataaacccaaaatacatacagaacgtctttttagaaaggtggtttacgattgtggatgatttagttttggccagaagcctctttggcacgacaatgggctttcatattattttcgcaacgcttggagtcggtctcccgctcatgattttagtggcggaattgatctatcaaaaaacgaaagatgaccattatgcgatcatggcgaaaagatggacgaaagcacaagccgttttgctgggggtcgccataccgaccggaacgatcgcgggcactcagctcgcgcttttatggccgggatttatggaagtcattggccgggtgatgtccctgccatttcaaattgaaatctatgctttttttgttgaagccctattcatgtcgatttatgtatacgctgcagaccgtttgtcacctgcaatgaggattgttgctgttttctttgtgttagtcggggcagcagcatcagctgttctgattacgaatgttcacgcttttgaaggaacgcccgccggttttaaaattttaaacggaaaaattacagatgttgacccgtgggctgcgttttttaatcctagcttttttatcactgccggccatgtcgtgctgtccgcgtttatgaccggtgcatttatcgtggcttctgttgcggcgtataaaatgatccggacgaggaaaaaggaaaaggtctatcgctttcaccggaaagcccttttgctcgcactgacgatcggcggtattttttcattgctgaccgctttgaacggacacgaatctgcacagatgctgtacgaataccagcccgaaaaattagccggtgcggaaggcctgtttgaaacaagatcccacgccccgctcgctatcggcggttttaccgacccgaatgaagaaaaagtaaaatgggcaatcgagattccatgggctttaagctttttggcagcgaaccgttttgacactgttgtaaaaggattaaatgcatttccgagagatgaatggccgccgcttttcattcacacgctgtttaatgcgatggtcggtgtaggcatgctgcttattctttattctattattggtgtggtctggagaaaggtgctcaagaaagaccgtttcccaacgtggcttttggtcattttcatgacagcaggcccttttagtctcatcggcattgaattcggctggattttcgcatgtacggggaggcagccttgggtcatctatcatttgctgaaaacatcggatgtcgtaacaacgactggttcgatcggagtgctcttcttgtttttcacatttgtttatgccgtgttaggcgctgctgtcgtctacgtgctgctgtactatttccgcaagcacccggttgacgaagatttaaatacagcggagtcgtaatggctccgcaaacaggaaaccaaatggaaggagatcgacaaatggagatttcaactgacgctctgatcgccatctcaattatctggggctttgtgtttatttacgccgtcatggcgacaatggattttggagcgggattttggtctatgatctatttaaacaaggagcatatgaaggccaccgatattgcgaatcgctttttgtccccgacttgggaggtcacaaatgtctttattgtggccatcgtcgtggcgcttttcagttttttccccggcgcgacatttgtgctcggcaccgttttattaattcccggaagcatgattttactgcttttagcgattcgaagcggatttctcgtgttttcaaatacagcaaaggagcggaaaacgctaagatatatttccggcatctccggctttatcattcctgctattttaattttggtgcttcctgtgacacacggagggtttatagaaaaaacggatggaatctataacttaaatatgtctaaaatcttttcaagccccaacgcctattcatttatcgggtttgcgattttaagcaccttatttttgtcctcgctgctgcttgcagatgtttcaaatgtggcagaggaacaggatgcgtaccgagcctacagaaaaagcgccctgattaccggcccgatttcactgttgtttgcagtatgcattatggtgacaatgcggaatgaagcaaactggctgtacagcggaatgatgaatgattttacttggattattgcatcgttcattacatttgtcattgctggaatcgccctttttctgcctaataagagctttgggcaaaacatcggaaaaccgcggcttgcacttgtcgcgattgggatacagtattttctcgcaagctacgcgtacgggcgggcgcatcttccgtatatgatttatcccgatgtgacagtcatgtcaggcttcacagagccagcaacgttcagagcgctgtttgcaacgtatatcgttgcatttatcattctatttccgggcttctttttcttctggaaaatgtttatgcgagataaacgctatatccgccaggaggaatagagggcaagccagccggctatactaatccagaacctttataaggaggggatggcatggagcagaaaattctatgtgaggtcaacaactgttcttattggggcaaaggtaacaaatgcaccgctgatgccatttatgttgtcagccatactggtgaaacggctgaaaacagccgggaaacagactgcaaaacgtttaagccgcatgatttgtaattaaaagaaagagctgcatcagccagctctttctttttgcatgttgagtgttctcagctttttagttatgaccccgtttgcaggtgaaaacaaaaaggcgcttgcataacatacacctgtcatggccgccatcgctcctgaaatcgaaacattaagccacgttgcgaagaaatagcccatgaccgccgacagcccgccaatcaacgcgctgagaatcagcatataaagaagccggtctgtcagcaaatgtgccgcagccggcggaacaatcagcatggccacaaccaatacggcacccaccgaatcaaaggaagcaacagtcgtcaaggacagcatgcccatttgcacgtaatgaatgagcaaaaccggtattcccaaggctaaagccatttgaggatcaaacgaagcgattttaaactccttatagcacacactgatcaacactacgtttaaaaccagaacagatgccagcatccaaaacgctttcggcccaatatcaaccccgaataccgtcaccgtattccacggcacaaaagcgatttctcccattaacgagtgctcaatatcgagatggacattcgctccatacacagaaagcaaaataaccccgattgcaaataaggatgtaaacacaactcctatggcagcatctgattgaacccccttgctatgaagaagctgaaccaagaaagccgttaacagaccggttgcggctgcgccaataaacatataaatcccatcgagacttcccgtcactagaaaagcgccgacaatgccaagcaacactgtatgactgattgcgtcggccagcatcgccatgcttctcagtacaagaaatgtgccgatcaatccgcagcttacaccgactaatacaccggtagctataatccatgcttcaaaactcattcgcgatctgtcccttctcggcatcatgagacacttttcgaagctcaggcatccgtccatacagctttaagagtgaataaagccgctctctcgtttctctcggtaaacggtccgggtcaaagtagtcctgatcggattctatattggcaagttccatttcatgcatgagatacacttcatacatccgctgcttcaaagctgtgtgatagcctttttcaatccctttgcttgtgatttgccaaatcccattttcgatacgctcaatgcacctctcttgttccaagtcatttaatgccttaaggcataatgaaggggataggcgtcttttctttcttacactttcaacagttacacaaagatttttcttttcatactgttcataaatcgccaaaagcacttgctccctgcttgttctgcgccgcagcctcatcagccttatggctttagcagccaatccccgcttaggcgcgcaaatcattgaaaaaagaaagagcagcgttgcagataagatcattaatggccctgtcgccattcccttcatcgtggtgctaagcagggttccggccactccgctgaccccgcctgtaatcccggcaatgatgatcatcccggttaatcgttcggtccaatatctcgcggttatggcaggtgtaatcagcatagccgccattaatatcacaccaacagtctgaagcccaatgacgacagcacagacaatcagacaagccaaaagcccgtttaaaaaacgcaccgggattcctaatccctttgcaaacgcgagatcaaaagtaatcaatgtaaattccttaaagaaaacaatacataggagcagcagagcagcggatatccctgcaataaggatgatatcctgcctgaccaatgaagcagcctggccgaataaaaaagaatcaagcccgctttggcttcccgccccctgttgctgaatatatgtcagcagaatgatcccgacgccaaaaaacacagaaagaacaatcccgatcgccgagtcctcctttgtttttgaaagccgaggaatcagctgaatacaaaacgttccgagcagtccggcgagcgctgcccccagcaaaaagaaaggcagtgatttttgcccggtgaacagaaaagcgagacacactcccggcagagctgaatgggccatcgcatcgccgattaaactttgctttctcagcagcacaaagctgcccaaaacaccgcttgccgtcccgagcaaaagcgtaccggccagcacccactgtgtattcggatgctgaagctgcagccacaaactttcaaacattgcgctcactccttatgtccttctgccagcactttatcttttaaaaacgtaagccttcctccatatgttttttgcaggttttcgatcgtaaaaacgttttccgccggtccgaaagcgattttccttaaatgaagcagtaagatccaatcgaaataatcctcggcggtctgcagatcatgatggacgacaagcacggtttttcctttttctttgagctctgccaacagcgtcataatcgcgcgctccgtcgctgcatcaacacctgcaaacggttcatccataaaataaatgtcagcgttctggcagagtgcccgggcaagaaacacccgctgctgctgtccgcctgacagctggctgatttgcctcttcgcataatcatgcatcccgacttttgttaatgcggccttcgccatctccacatccgctttctttggcctctttaataaaccgattctcccgtatcttcccattaggacgacatcgagcgggcttgtggggaaatcccagtcaaccgagccgcgctgcggaacatatccgattctggtccgctgatccttatagtctttgccgtaaatagagatgtctccggaagctctgggcacaagaccgagaatcgttttgatcaaggttgattttcccgcgccgtttgggccgataatgccaataagttttccttcaggcacctgcagcgaaatgtcctgcagtacaggctttttatgataagcaaccgtcacattatcaagctcaacagggaacatatcctccacctcttttctttatttaagcgctttagtaatcgtgttgatattgtgacggaacattccttcgtatgtgccttcttttgtgcccttttcacccatggcatccgaataaagctgaccgccgattgtgactgtatggcctttttctttagcgccttccaccactgcattgattgatttttcagatacactgctttctacgaacacagcttttatttgtttttctgtcagaagatcaaccagctcctgaacatcccttaatccatagtccgaatctgtgctgagtccctgcaggccttttaccttaaatccatactcattcccaaagtacgcaaacgcatcatgagcagtcacaagcacacggcttttctccggaatatgtgcgatctccttacgcgaccacttatctaaatattgcaaatcttctttgtactctttggcatttttccgaaaggcatctgcgtgctgaggcattgctttgctgaattgcgcttcaatttcatccaccgcatagatccataacggaatgctgaaccagacgtggggatcaaacgtcttgccttcccccgcgggaataagcttatttttcggaatggcctcagctactgccgccgattgtttttgttcgccgattttttggaggacatcctccattttcccttccaaatgcaacccgctgtacagaacaacatcggcagacattaattttttcgtgtcaccttgggaagctttgtaaaggtgcggatcaacccccggtcccattaaagaggtgacttttacatgcttacctccgatgttttctgctgcatcggcaatttgagatgttgtcgctgtcacttgtaattgctgatcagcgctttttccggctgaatccgttccgcatcccgttaaagcaaaggtcgcaaaaagtactgctgccatcagcccttgtctcatatttctcctcctctttgccatcaatgtccgattgttttatcttatgttgtcagttcttagacatgtgacattaaattagccaaaagcatgttttatttacacaggacaaaaagtttcccttatgcaaaattatcgcgtttggccatttttgtcaagctgatttacataaaaaaaccggctgggtcagcagccggtccaaacgagaagggatgtattcaacgaacacttttactgtaacagcacagtgtcatttattcaaaatagcaaaatgcttttttcttaaccatgctgtgtgaaaacatccattttggtcacatattttcgcataatatcttggtttacctcaacccctaaaccaggctgttttgacacagaaataaatccattatcaatacgaatatcaggagttacaatatcttcatcccaatagcgtgaggatgaagatatatcgccaggtattgtgaattgaggcagtgaagcaagcgccacgttctgcgctcttgatatgcctgtttccagcattcctccgcaccaaacctgcatatgatgctctttgcataaatcatgaatttttaaggcttctgttaagccgccgacacgagaaggttttatattaataattttgcagcttcctagctcaatcgcccgtctcgcatcatcaactgaacaaatgctctcatcaaggcaaatggccgttttcaaatgtttctgcaagtggcggtggtcaacgatatcgtcagcttggagcggctgctcaatcatcattaaatgatagtcatcaagctcctttaaacggctgatatccttcagttcgtaagaggaattggcatcggccataagcgggatgtttgggaatcggctgcggatggccttgaccaattccacatcctgcccaggctgaattttaatttttattctttgataaccttctttttgatagctctcaatttccttcagcatatcgtcaagaggcgccaggccgactaccaccccggcagggactttatctcttgttccgcccaatgcctcagcaagggatacgcccttctttttggcataaatatcccatacagccgattcaagtcccgcttttgccatccggtttcctttataccgcgccaggctgtccggcacttctgaagggtgattgaattcacggccgacgacatttgggataaaaaaatcttttagcatatgcaaacatgttccaatggtttcctcggtgtaccaaggcgaagagaaagcggaaacttctccccagcctgtgacacctgatgtatcaatggcttccacgatcagaaatttacgctcttgaagcgtttcgatactgtttttaaacggtttctttaagttcatgctcaaatggtaaagcgtgattttttctatttcgatcatagcagttctcctttacgcgcatccttcagctgatttcgcaagagcttattagacgcattgcgcggcaggcggtcaagcacaaagaattttgccggaattttatacttcgccaagcgttctttgcagtagtcagtcaattctcctgcgctcacaggcttgtgaaggacaagataggcgtgaggcactttcccccattttttgtcctcagcccctgaaaccccggcttcggccacagcggggtgtgaaagcagtactgactccacttcggccggataaatgttttctccgccggatatgatcagatctgaacgtctgtctaatacatataaaaagccttcattgtccaaataaccaagatcacctgttttcagccagccattttgaaaggaggcttcgtttgcgctctcccggttaaaatagcttttcatgacattcgggcctttgaccatgatttcaccgtgttcatacggttcacatacctgtccgtcccgctctattttgatttcacatgaaaacagcggtttccccgcagatccgagcttttccatactgaattccggcgacagggtaacaatttgtgagcatgtttctgtcattccatatgactgaaagacagggaatcctttctcacggcattcctcaagcaatggcagaggtgcagggccgccgccgagaagaatgcatctgatggattcagggcagcggcttgtttcttccaaaagactggccagcatagtctgcaccgcagatatcattgtcacttcatgcctgttgatagaattcagcacatcgcttacggaaaaacgctggtgaagcacgacagtcattccatagatcacagatttaaataatgcggacaatccgctgatatgaaagagcggcaatgcgataagccagcggtcttgttctgttatacccaaattaagcgcggacgacaccgcactgaaatagtggtttccgaacgtttgctgaactcccttgggctttcctgtcgtacccgacgtatacatcagcgttgccgttgcatccatttgcatataagcctcgatctcaatttcctctgctgcttctttcatcagttcatccacatcaatcgtttgaacgatgtgttgatattctttcttctcaaagcttgaatctgtcaataaaaagccggatcccgaatcctccagctgaaacagcctttcatgtgttgacagcttcgtattcaaaagcaccgccttaacaccaagcaaaaaacaagcgtgaacagcgtataccatttctgcacggttttggagcaaaatagctgcagtatcccctttccgaaccgaatgagcggcaagctgttccgccattcgtttagacgcggcaaacaattctgcaaatgtcacggtttggtcttcatagatgagagcgattctctcaggtgtcagctgtgcccgctgcatgagccagttgggctgttctgtcagcatgtcatcatctccgaggtaaaatgtctgtattgaaaagaaaacagcttggaccgcaaagtctcaagctgttggtttactaggtattgctgatcacggaaaacgagggaactgtccgaaatcaggtttgcgtttttccttaaaggaatcacggccttcttttgcttcatctgttgtgtagtaaagaagggtagcatcccctgcaaactgctgaattccagcaagtccgtctgtgtccgcgttaaacgcagctttaagaaagcgcagtgcggtcgggcttttttcaagcatttcttcacaccatttaatcgtttcttcttcaagctgttccaaaggaacgactgtgttgacaagacccatgtccagtgcttcctgtgcgttgtactgacggcataggtaccagatttcacgtgcttttttatgtcctacaattcgagccaggtagccagaaccgtaacctgcatcgaagcttcccactttagggcctgtttgtccaaaaattgcgttgtccgcagcaattgtcaagtcacatacgatgtgaagcacatggcctccgccgatcgcatatccggacaccatcgcaacaaccggtttcgggatgacgcggattaaacgctgaagatccaatacgttaagacgcgggatctggtcgtctcctacatatccaccgtggccgcgcactttttggtctccgccagaacaaaatgccttgtcccctgcaccggcaagcacgataaccccaacgttttggtcgtctcttgcgtcagcaaacgcatcaatcatttcagcaaccgttttaggggtaaacgcattatgtacctcaggtcggttgattgttatttttgcaatgccattatacgtttcatacaatatctcatcgtatgtccgttttgttttccattcagccatatgatgacctccttttattctctatgtgaatgagtcagatgcttgtcaaaaactcactcactattttaccaaacaatcgcggctgttccacatggaccgtatgtcctgcttttggaacaatctctattctactagaaggaagcatcttatgcacctcttgattgatggcgcaaaatttttcgtcccactccccgcagataagaagcacaggaacatctatttcctctacacggctccacaaggaaggctgtgaaccggtgcccatgccggttaaactgttcgcaagcccaatcttattgttccgcagacggcccgatcgtatcctgtgccgaatatcttcagccagcctctgctgagatgaaaacaaagggatattctcccaatacgcaacaaacgctttgagcccgtctcgtaaaataaaatcagcaagcttccggtcccgcatgattcgttcccgccgttccccaagtgttttgagccccggcgtcgtgctttcaagcacaagtgccgatacccgctcgggatatgtcatcgcgaaagagtaagcaagccttcctcccatagaatacccaatcaatttcactttgtgaagttttaattgatcaaaaatctcggcaaggtcagaaacttgccggcttgtgctgtatcttttcccattcagcggggcatcggtttccccatgccctaaacaatcaattttgatcaaacgggaatcaggcagcatttcatcaagaaaagtccatgattgtttgctgccggtaaacccgtgcagacagacgacggcttcggaagcattcggtccctcgtctgccactgcatatcggacaccatctgataccgttatgtttacagttcccattgttttttcacttcccgcacagcctcattcagcatatcgcgatgaagctggactcttgattggcgatccgttttgatttcaatcaaatggagtccgggcttgtctgcctgcggcgcgtaagctgttttgaattcatcccaagaagccgggcatgaatacgttccgccgtaaagtgcagcggcatgcttgaaatcgagccctgtcggtgtgccgaacaaatcttcaaagtgtgtcttctcagaagcctgcggcaaaaaggagaaaatccctcccccgtcattattgacaagaatcacagtaagtggaatacccagctttttggccgccagcaagccgtttaaatcgtgataaaaagataaatctccaatcacaagggtaacaggcgcttttgttccttcacatacccccatggcagaggagacgacaccgtctatcccgtttgctccccggtttgaataaatccggaaagggcggtcctgcttttcgaaaaacgtatcaacatccctgatcggcatgctgtttcccacaaacagcgagctgttttcaggcacaagatgctgaaggattcgatagagattgccttcaaacgaaacatcttcactgctgattgtttgcagatgctcgcggaaccgcccattgacaaactgccacttttccagccactctgaggatctggcagcagcagtaaggcctcccatgatctcctcagcaaaaacagacgcattacaatgaatcatatgcgcgcttgcctgtgtcgggtctctccaccctccatcctcgtcaatcactatttgctgaatcgcaggatcatccttaagccataagaaaaccggttttgaaacaggcatcggtccaaaccgaatgacaacatcaggacgaagtttccgcttcagctcatcatcttttaaaaacgaatcatacgcatcaataacagtgcttttatcatgaacaccattccgcagattagacagcggatccgctaaaattggatactgaagcgcttttgacagcgcaataatgttttccttatccgcatcactatggagctccccgcagacgatcattcctttttcagcctctgcgagcatctcagccacatcagacagggactctcggtcaacagactgcgtacccgttttcacagacacatgacggcctgttctcattcttccaaacggctcatctgaaagatccggcatcagcggttcgcgcagcggcacattcacatggacaggccccatcgggcgcttttgtgcttctccggcagcgcggcttgccagcgttcggatgtatctcagcatttgcggagactcttcaggaagagcagagtctgtgaaaaacttaacaaagttaccgaataagaagtgctgattaatagcctgcggtgcgcctacttcgcgcagctcatgaggccgatcagcagttaacacaataataggcacccttgaataatgggcttcaaccacagccggataaaagttggccgcggctgttccagatgtacagatcaatagtacgggacgctgcttcgcttttgccaaacctaaggcaaaaaacccggcagatctttcatcaatttggacatggacgctgatatcgggatgcgcagcacaaagaacagccagcggtgtagatcttgagcccggacaaacgacggcgtccgtaattccggaaagggcgaattcatcaataaaacttccgatgtaatgagtaatcgggttgactgtcaacgcctctcacctcctaatgcagagatcatcggcttcaatttaatctgtgtttcttcatattccgagattggttccgagtcttccacaataccgcacccggcaaacagccttgcagtgcttccttcgatcagccctgaacgaatggctaccgcgaattccccgttatcctggctgtcaatccagccgataggggcagcataccagccgcgagacatcggttcaatctccctgatcacgtcaacagctttttcctgaggtgctcccccgagcgccggagtgggatgcagcttctcaattaagtcaaaaattgaagcagactcgcgcagctgtccgacaatcggcgtaaacaggtgctgaacgctttttgttttgtacaaaacaggtccatcaggcttttcaacctctgaacagcttgatacaaaagcattatgaatcatacctaccacaatatcatgctcaagcaggtttttctcatcgtttaataattcaaggcctatccggcggtcgtcttcttcattcacgcctcgtttaatggagcctgccagacaggaagacatgacagtgccgccgtctcttttgatcagtctttccggagacgcgccgacaaaggttttgccttcttgttcaattgcaaaaacatagcttgtctgctgatcgtccagaagcgttttaagcaccggttcaatttggattggaccgtcaaacgtgagcagcagctctcgggcaagaacaaccttatcatattgtttctctttaatttggcttgtggccgtttcgattgctttcagccaatcatccttatccagctcttcggctgctgcaatcacagcctgatcttcttgcttgaaatcgggaaccataaattccgccgcaaaagcttttaagccttctaaaacagcttctgcgtcttctcctccgcttacccatctgttaactgttaagaacgggccttcagcagtcatcgtcagcataagcgcaggcacaaagaaatccccttccgagaaatggtcccattgtgaacctctttcttcgcaagggtcaaaagaaaatcctccgaataacacaggtcccactgcagaatgctgcagcttttcttcttcataaatatgaaaagccgtctttttaaagcgctcccattgttcaaaaacctcacgataccgctcgctgtttttttgatttgtctggaaaaccgcttctttgccaagaccgactattgtcaattcactttcaggatctgaccaaaaaaatcgattgcctgtatatttttttgctccgtaattgaaaaatgatagagggtcaagagactcgatttgtctcgaatagcttattaagacagcatggttgacttctttggctttatgtaatgcatgtagaacttcctttcggaacgtacgctgcaccgttgtcaccatgagacattcctccataatccttaaaatgcttttaataccatacacctgtgtctcctttgtgtcaaacacagatcatgcagtccaaatggcctgccttacctattataaacctaatttcagaaatgaaaaagaaacaaagcttaaatttctttctccactgatagcaaaggttgtatccgcttaccataaaaggaaaacctcctatattcctccacccgccatttatgaaagttctcaggcgatctgttcatactaaaggtatgcatcacagagaaacgaggcgatcacattgcttacgaaagaacagcttcagcatttaaaaaatgaactggaacaaacgaaaaaagatatcttaaaccgtttcaaagacaatgaccattttcagcttaactcagcctttccttatgattcgtggggtgagctttcggcatacgacaaccatcccggcgatcaggcgacagaactttacgagcgtgagaaagacatcgctctagacttgcatgagcgagagcaccttcgggacattgagcattcattgaaggcgatagaaaacggtacgtatggcatttgtgaagtcagcggaaaggaaatccctttcgaacgacttgaagcgcttccgactgccacaaccctcgcggagtattcgtcacaggacgtggtttccaaagaccgtccgattgaagaagaaacaccattcgggcaatttgaatttgatgatgatgaagaaatcagagcgccatatgacagtgaggattcctatcaggatgtcgaaaaatatggtaactcacaaacgccgcaggatatggaaaaccctccgctcagctatgatgatatgacgatgaataccgaagagaatatcggcaatacggagtcttacgaaaatttcatcgctacagatatcactggaaaagaaattaccgtttatcaaagcagagcccatgagcgctatgaagaagaacttgacgaagagggaatcatgaccacattcggcgatctccacgctgattgaacccccaattattgggggttcttttccgttttcagcatatcgtaaatcagcttcagataatccttttgcaggccgatgtcataccgctcgccctctagcaatttcccgtatacggtacatgccccgagcgaagcttttatcgcatccgttacctgcacttctcctccgctatcagcttctaatgcctccagctcattaaaaatatccggtgtgaaaatataacgccctgctgcggcaaaatgagacggagggttttgtttaggcttttccacaatatcctgtatgcgataaagccctttttcaacaggctccccttttatcaccccgtaatgatgtaaatcctccgtttttgtttcttttaagccgatcacactggactgatatttcgtatacgcttcaatcagctgccccaaagccggctgattggcggaaaaaatcagatcatctggcaaaacgacggcaaaaggctctccgcctgcaaattgctttccgaaagaaatggcgtcgccaagaccctttgcataaggctgccgcacatagtgaatccgtatatccggaatgggatgctctctaagtaaatgcagtttattcttagaggccaaaaaagcctcaagtgccaaagaggaatcaaaatagtcgacaatcagatttttatggctcgatacaaccatcaaaatgtcctcaatgcctgactcctttaattcttcaacaagataatgaatcacaggcttagatcctaccggaaacatttctttcggaatcaccttcgtcaccggcagatttctcgtgccgaatccgcctgcaggaataatcgctttttttatcatggtattttcccctcagctcatgtttattacatgatattccaagagcgcatcccgatgtttgtacatctgaaattaggcggaagcaactgggcagaaagcggaatcacgaaccagcccttttttaataggatattgatatatgaccagtaatcttgtaaaggagctcaggtgatgaaaatttgtgtggttggcgccgggtatgtcggtttaaccctatcagcggcactggcatccatcggacatgacatgatatgcacagacaaagacgtcaaaaaaatcgggcagctgaaaaaaggagtcattcccttttacgagcctgggctttcagatgcaatacttcgttgcggcaatctctcgttttcttctgaagtgaaatcgagcatggaggaatgtcccgttatttttatcgcagtcggaactccgccgcgttcggacggatcagctgatacgaaagccctgcagtccgtcatcggtgatttaagcgaggcgatccgatcgtataaaaccattattacgaaaagcactgttccgcccgggacaaatgaaaacatagcaaaacagctgattgcctccggagtgtctaaaaacctctttaatatcgtatccaatccggagtttctgcgggaaggcaatgccttatatgacatgctgcatcctgacaaaacagtcatcggtgttcaggaagaagatcacgtatcggcagccatcgtcaaatccatttacaaacacattgataccccttttatcgttacaagcttagcgggagcagagctgatcaaatatgccaacaatttctttttagcggccaaaatttcgtttattaacgaaatggcccgcatatgtgaagcctatcaatcagatatctcagatatttcccgcgctatcggtctagacccaaggatcgggaagcactttttgcaggcaggcatcggatacggaggctcttgttttccaaaggatctgcaggcgctgcaatttgctgcccaggaaaaaaacacggagaccttcctgctccgggccgtgcagcacattaatgacacccagctcggcctgtatatcaaaaaaatacagtcattcttcgaaacacttcaaggcaagaaagcggctgtactcggcatttccttcaaaccgaatactgatgacatcaggaattctcaggctgtcagactgatggaaaggctggcggagctgggatgtgatgttcatgcatatgatcctgaagctgtacttccagaacatttgcggaagcatgtaactcagcattctcaagcttttgatgcgatcgaagaaagcgactttttatttttggcgacagaatggcccgagtttttagcgtttgattggaaaaaggctgcagatatcatgaaagggcgtcttgtgatagacgggcgcaacgtactgaaaaaagaactgatcgagacttgcggcctgatctgtacgggagttggccgtccatgaaaatactcgtcacaggagcagctggctttatcggctcccacctctgcgaagaattactaaaagataagaaacataacgttatcggaatcgatgactttatcggtcctactccattttccttgaaattaaaaaaccttaaaaacctgctgccggaaaagcgatttacgttcataaaggaaaatctgctgacagccgatcttgctcccttactggaaggagtggacgtcatctttcatttggcggccataccgggtgtccgctcaagctggggcaatcattttcacccatatgccgcacataatatccaggcgctccaaaggctcctcgaggcgtgccgggaacattctattcaaacgttcgtctttgcatccacctcttccgtctatggcgaaaaacaaggaaaagtcagcgaaaacacgtcgctttctcctttatctccgtacggggtaacaaagcttacgggagaaaagctttgccatgtgtatcaacagagctttggtattccaattgtgattctccgtttttttaccgtatacgggccaagacagcggccggatatggcttttcaccggctcattaagcagcaccttcagcaaaagccgcttaccattttcggtgatgggcagcagtcaagagatttcacttatatcggcgactgtgtcaaaggcatcaccgctgttcttgggaaaccccaccttattggtgaaacagtaaatatcggcggcgcagagcgtgcctcagtcttaaaggttgtctccctcattgaggatatttccggtagaaaagcaacactgcacttttcggacaaaatagcaggggaaccgagcaacacgtgggcggatatttcaaaagcaaaacagctcttgcattatgatcccgccacatccttaaaggatggcttgaccaacgaaatcgcctatttatcgtcgctgtatcagggggaataaaaatgaagcttgcctttatctgtacagaaaagctgccggcgcccgcagtacgcggcggcgctattcaaatgatgattgacggtgtcacgccctatttcagcagcaggtacaacctgaccattttttcaatagaagatccatcgctcccaaaaagagaaacaaaagacggcgtacattatatccatctgccaaaagaacattaccgcgaggcggtagccgaagagctgcgagcctcttcctttgacctcattcatgtgttcaacaggcctttaaatgtctctttatataaaaaagcctcaccaaacagcaagatcgttctgagcctgcataacgaaatgttttctgaaaaaaagatgaccttcgcgcaaggaaaagaagtactcgacaatgtctccatgatcacaacagtgagcgaatttattaaacaaaccgtcattgaacgtttccctgaagccgaggacatcacaaaagttgtgtattccggcgttgatttaaactcttatccgcccgtatggacgatgaaaggctcggctgtcagaaaaacataccggaaaaaatacggtattgaagataaaaaagttattttattcgccggccgcttaagcccgataaaaggacctcaccttctcattcacagcatgagaaggattttgcagcagcaccctgatgctgtactggtcatagcgggcgggaaatggttcagcgatgacagcgaaaaccaatatgtaacctatctgcgcacgctggcgctgccatacagagaccacataatctttacaaaattcattcccgcagacgacatcccaaacctttttctgatggcagatgtatttgtgtgcagctctcagtggaacgaacccctcgcccgtgtgaattatgaagcaatggcggccggcacgcccttaattaccacaaatcggggcggaaacggagaagtcgtaaaagacgaagtcaccggccttgtcatcgacagctacaacaaaccttcttcatttgcaaaagcaattgacagagcctttacagatcaagaattaatgaacaaaatgacaaaaagcgcccgaaagcatgtagaagctttatttacctttacccatgctgccaaaaggctcaatactgtttaccaatccgttctgaccccgaaaaacaaacaatttccgccgccttttctgacgcaaaattttgatttatcatctatcaatcagctttttgtgaaagcaaaaacataaaacctacagctcgtgttgcaaaacgggctgtttttttgctgcagaaaacataaaaaaaggcataaatgtgactttatgccttgcgctttacggtttgagaaaaccatggagctggtttagattcacttggaagaatgatgatttccactttagcttcttccgctaagtctggttcttcatcttcatcctcttcttcatatggggacactgagcgtttcgaatcacgctcctcctcaggctctagaatggtttcgaatttcgtttcttcttcatcatcgacgattttgtgatctgtttccttttccttcgtttcttcttgatattctttcggtgcattgatgtgagggagctctcgaatgctgcccacatctaaatgcttctcctcttcttccttctcagctgacattgagtcatgagcctgccaccccatcggcccaggcggtgtaaatacgaattggtcgagatccagtttagaaatagaggctttttgtctcgatgacctcatgtcaattcgcctcccgatacgcttttatctttttatacagttccggcagtttatccaaaaacgaatctttagattcttcaacagaaatcatgttttgcagcgcccagttatatttctcatctgaccacgttttcttttgcttcaaataatatttgtgcccgattgcacagaacaaatgcggaaacgcgagatcaatccaaagtacctcgtactgtttttctgtgagcggatacactgcgtcgtaggccgcaagcagtgcgaccatgaaatcagtatcccatacagaaagcttaaccatcactttattcagcagaatacgaaggtctcttgacggcaaatcgtaggtaatcgagtgaagctcctttaaaaaaggctccccttcgatctctgtcaaacgtgccaatgtaaaatcttgaaaacagaatccgccatgctcgagcgtttcttttgtccaggtttcgtattctgagtcatcaagcgcctgaagagcttcttttcctcttgccagcattttatcagcatgttttaagaaagtttgcgaaaatacgtcatcaggataggatgccgcgatctgcatattcccttcaagttcctgcagcttccatcggtacaatttatgccattttcccagcctgcttctcttcttgctttcatctgtgcaaacatatccttttgaggcatgatgaaaatggccggcaaatgacatgacttttttcatttgctctgcatcatagtaaatcatttcttttcctgtcactttgtcatataagctgtaagaaacctgatccgtgcccaagcagctcccgccattttttgtttgatgaatcggcgctatcggcagccctttctcttgtaaatgagcgtgtgcctgagtgataaaaagcatccgctccggtttcatttgcgcttcttttagcagctttgggccatgatcagtttcgacttcccagattttgcgcccgcttttgttcgatttcagcgccacatggtcgatatgaaacggataatagctgagaatttcggacacaatctgttcttcatgctctttttggtacactctgttcaccccttctatctgttcttttcatagacgctgagcagattttcagccaccctctgccagccaaaattgctttctgcctcacggcggctgtatttcccaagccgttcccgcttttcagagctgctcagcaaatcattgatacgttcggcatattgtttaggattttcaaagtcatgaatgatgtagccgtttttcccttcctctatgacctctggattgcctccccgattgcttgtgataattggaagtcccgcagccatcgcttcataatgcacccttgctaaaggctcctgccattgcgaagagcatacaaatacatctgacatggtataaaggcgcggaatgtcctttggcttcacaaattgaataaatgtgacatgatccttttgcatcgcaccaagggtatgaagatgtttgacatagttatttaattcattatctccgaaccattttgacccgataaacaccatcatgacatcggggtgctcctcaatgatgtccggcaaagcctgcaataatatgtgcgggcctttgactttgctaagccggccgacaaacaagacgatttttttgccgtgaagccccagctcgcttcgcatctcttcgcgagctcgctgcccttcattcgtccagcgagggtggtacgtttttaaatccacaccagaatacaccgtttttgtttttgatcgtgctgacggaaaacggcttgtgatcgtctgtccgatataatcgctgaccgtaacaatctgcgctacggagtcgatgcaaatctcgccttccgcctggctgattttatcgtaagcgaacatttcattgtgaacgcttaaaataaaaacagcatccggcgcctgtttcttcaatttcggaacccagcttgggcgattacaaacatgcacaagatcaaaacggctctttttcagctctgctccaacggcttcttcataacggtcttcatccaaatgcacataatggacaccgtctaccttctctctatcagcgagattcggatctttaatagaaaacacagtcacctcatgtttttttgcaattaaaggggcaaccgcttcgaggtagatttgaatggcgcctcctcgaaccgatgggacaggaagcttctctgtggcgatcagtgctattttcatacatagcctccattcctgcatgatttttaactagttagaatcatgatacggctgaacaaccaacttgtgcggaatgggactgccctaaaaacaaaacgggtaaacaaccagattcatctattaaatatagtcaaataactcaatcattttttccttttgattcataaggtaggagtaaaacaggtaaggatgtgtcctttaatggcagaaaaccatgaagtcattgaggaggggaattcatcagagcttcctttatcagcagaagatgcaaaaaaattaacggagctggctgaaaatgtgcttcaaggatgggatgtgcaggctgaaaaaatagacgtcattcagggaaaccagatggcgcttgtctggaaggtccacacagactccggcgcggtttgtctaaaacgaatacacaggccagaaaagaaagcgttgttttccattttcgcgcaggactatttagcaaaaaaaggcatgaatgttcctggcatactcccaaacaaaaaaggcagcctatattctaagcacggctcatttctatttgtcgtatatgactggatcgaaggaagaccgtttgagctgactgtaaagcaggacttggagtttatcatgaaaggccttgctgattttcatacagcttccgtcggatatcagccgccaaatggcgttcccatatttaccaaattaggtcgctggccgaatcactacacgaaacgatgcaaacagatggaaacgtggaagctgatggcggaggcggaaaaagaagatcctttctcacagctttatcttcaggagatagatggctttattgaagacgggctgcgcatcaaagaccggcttttgcaatcgacctatgttccatggactgaacagctgaaaaaaagccctaacctttgccaccaggattacggaaccgggaatacactcttaggagaaaatgaacagatttgggtcatcgacttagataccgtatcatttgatctgcctattcgcgatttgcgcaaaatgattattccgcttttggatacgacgggtgtttgggatgacgaaacatttcatgtcatgctgaacgcatacgaatccagagccccattaactgaagaacaaaaacaagtcatgtttattgatatgctgtttccttacgagctttacgatgtcattcgcgaaaaatacgtccgcaagtctgctttaccgaaggaagaattagaatcagcttttgaatatgaacgcattaaagcaaacgcattgcggcagcttatttaagaccatcatttcccccgcatatcgggggtttgatctttataagataaagggtaattaaatacatgcggaggttgcaaatatgaaaaagattgtcggcgctttagccgtttttgtgattacatatgcgctgttttcagccgcaggctacctgtttcctgtggaccaagaatggtacaattcattgaaaaaaccggactggacgccaagcggaactgcgatcggcatcatttgggccatcctgtttgccctgatctccctttcagcagccattgtatatgctgcgttttcatttaaaggtgcgaaaagcttttggtttacacttttgataaattacgtgctcaatcaagccttcagctatttccagtttacgcaaaaaaatctgctggctgcatcgcttgactgcctgcttgtcgccatcacagcaatcgtattactgatcattgccaaaaaatacagcagagccgcaagctatcttcttttgccttattttttatggagtgcatttgcgacgttcttatcctttacaatcaattcaatggatctgtgaacaaaaaaagccgcttatacagcggctttttcacatcatcggcttgatgccccaaatgtccttcgcatattcccggatcgtgcggtcgctggagaaatatcctgaatgagcaatgtttacaatcgaacgctcagaccatttccttcgctctcgataatcagcttgaattcgctcctgcgcatctgcatatgagctgaaatccttcagcacaaaatactcatcattatgcggaagcagcgagtcaaagatcgattcaaattcatctgcttctccttcaaaaaaaccattgatcagctgatccgctacctgcctgattcttctgtcatgctgataatattccctcgatctatagccaccattttcctgatacgatagaacctcatccgcctttaagccgaacgtgtaaatacagtcagggcccacccgctcaaagatctcgatatttgcgccgtcatgcgtgccgatcgtcaaagccccgttcatcataaacttcatattccctgtaccagacgcttccttgcttgcagttgaaatttgctcacttacgtctgatgccggaaaaattcgctcagccatagaaactctataattttctaaaaaaacaactttgatcagctgtttgactgccggatcataattgactttttctgcgacagaatggatcagcttaatgattttcttggcataataatagcttggtgaagcctttgccccgaaaataaaggtttgcgggtagattgaaaacccggcgtcctccttgaggcggttatacaaatacataatgtgaagaacattcagcagctgccgtttatatgcatgaagccgtttcacctgtacgtcgaatatgctgtcagggttcacaaccaccccggccgtgcaaaaaatcaaatcggcaagctcttgttttttcttgcttttgttgttttgaaactgttcaataaatgcaggatcagtggcgtacggttctaaacggatcagtgattccggctgtttgacccattcatcgccgatcgcctctgtaatgatggcagacaagcctggattcgcttttaacagccagcgcctgtgggcaattccattcgtcttattgttaaaacgattcggaaacagcaagtgaaagtcgcgcatctccctttccattaatatatcggaatgtatttttgcaacgccatttacactgtaactgcctactatggccagatgagccattttgacaacaccatgcgctgtaatcgccatgtcctctatccttttccagtctcccggatacttttcccaaactgcgcggcaaaacctctcattgatctcttcaataatcatgtacattcgcgggagcagcggcttaaacaaatgaatcggccatttctcgagcgcttctgacaatgttgtatgatttgtataagaaatcgtatgtacagtgatatgccaagcttcttcccagctcatgttctcttcatcgagcaaaatccgcatcagctcaggcaccgcaagcgcagggtgagtgtcattaatatgaatgctcacttttttatgcaggccggataaagatttatgtgtttttcggtaattgttcacaatgctttttaagcttgcgcatactaaaaaatactgctgcttcagccgtaaaattttcccctcatcatgggtgtcatcgggatataagaattcagaaaccgcctctgtttcccgcttataagacaaaatattaccgccgtgataatgcgcatagggctcggcgttccagagccttaacgtgttgacagtgcccgtttcatagccgatgaccgggatatcataaggaacagcggtaacaattgtcgcttgttcgtggcgaaaatgcaggcgcccgcttttttctgtcatatggacttcgccccaaaacggcacgtccactgcttgatccgcattccttacttcccatacgttcccgtttttcagccattgctcaggcagctccacctgatgcccgtctacaattttttgctcaaacaaaccatgcttataacgtatgcccatgccgtgcccaggcaggttcaacgaagcaagcgaatctaaaaagcaagcggccaagcgcccaagtccgccattgccgagacctgcatcgttctctatctgaaggatctcctctaaattgatgccgatttcctttaaaccagcttctacaacatcacgaacaccaagattcattaagttttgctcaaggagctgaccgagcagaaattcgattgataaataatatgtctgcttcccggaatttgatctgcttttttcattcgtttcgatccaatcagcgctgatatactctctgaccatattgcccaacgttttatattgatccagcttggcagaatctttaaagctttttccgcacgtcatttccagacgctttaaaaataagtctgcaaagcgttctttactcgagaacatcccgtccactccttgtcacctgctcgaaaatacgctgatactctttagccgacttcccccagctgtaatctgcattcatagcggtcttcacgatgctcttccatacatcctgttggcaataaaacgacagcgccctttctatcgtaaatttcagatcatgcgcattaaaggcggaaaacgtaaagccattgcccgttccctcttcctcctgataggcacggacagtgtcgtaaagaccgcccgtttccctgacaatcggaatggcgccatattgaagagcaatgagctgccccaaaccgcacggctcaaatttcgacggcatcaaaaacatatcagagcccgcataaatttgatgggctagcggctcatcaaacccgatataagcccggcacttctcatgaaaagcaaattctgcataccggaaataatcttcaaattcacgttctcctgtgcctagcacaaccagctgtatgtcttgctcctcaagaagttcgtgcataattctgcggacaagatcaagccccttttgtttagtgagccttgtcaccatactgatcagcggaatatcgtttttctctggaagccccatccgctgctgaagcttcgttttgttttccagcttgcatgcaagatcccctgaatcgtattgcgcctctatataagggtcgcttttcggctgatagaacgtatcatcaatgccatttaatatgccggttacatcatcttccctatattgcaaaacctgttccaactgctcaccataatacggcgtcatgatttcatttctgtaagtggggctcacagttgtcacatgatcagccgcaatgatgcccgctttcataaaattaacaaatccgttgcattctaacctttcataatgaaaatgatccatctcaagacccagcaagtcatgtgtgacatcaggagggaatatgccttgaaactgcaggttgtggatcgtgagcacgcttttcatccgttcataaaaaggatgttttctgtactcctctttcagcaaataattgaccatcgctgtatgccaatcgtgagtatgaacaatatcggctggaacattcacaactttggcagcctccagcacagctcttgaaaaaaaggcaaaccgctcaccgtcatcataatgcccgtacaacgaatccctgttgaaatagtactcattgtcgatgaagtaataattcacatcgtcttcggccatatgttcaattccgcaatattgctgacgccagccgacagctaccgtacactcagccttttttttcatacgctttttccacggttcaggtatttggctgtacttcggcagcatcacatatacttcattgcctaatcgcgcaagcgccttcggaagagcgcctgctacatcggcaagacctcctgatttcacaaatggggtgcattcagacacagcaaataatatcttcaagaattcatcagctctccttgcaccaaaccttttcttaatacaagcggctgctcagctgttcctacagcttccgtcgccttgccgattttaacgtccttatccgaaatgacctgctcaagaagacaatcctcgccaatctgcgttttttgcataataatacagtttttcagcttcgtaccctttccgacatggaccgccctgaacaaaatgcagttttcaacctctccttcaagcacacagccgtttgccaccaaagaatttttgacagtgctgtgctttccgtatttcgtaggcggctcatccttcacttttgtatagataggctgctgcggcaaaaacacctgctgccaaaaacgaggctgaatgagctccatactgtgggtataatatttttccaccgaatcaatgacagcagcataacctgaatattcataagggcaaatggtcagggcggaagattccttttcaacagcctcctgaatggttttatagcctttttcgctatgtccgtagatcagatcctttaaaagcgttgttgacatgatatagatttgcagcgactggccgtcctgaaatacctcggtgacgtcgcagccaacctcctgatggcgtttcagcacatattgaaattgaatgttgcatacggtatggctgttggagattacagcatattgctgagtgcttctgtggaagtaatctagatggtccgaaaactggcgaaaggaaccgaattcatcgtattcgtgatgaagatggggagacgggaaaaaaaagaggccgtcctttttccggtgcaaatcccattccttacccgccccaaggtgatccatgagcgaacggtaacgatacttcggaaaaattgcaacactcctaatatccgcattcaccatgttggaaagcataaaatcaatcagtcggtacctgccggcaaaagggatcgccccgagcgaccgctttgctgttaaatcctgaagagaatgcttatatgtggtttcatctataacacctaacatttgattattgaacactgactctgccccctcttcagtaattaaatcaattctttttctacaaattcctctgaaacgagcagcacctcttcaatgtctttttcggagcgaatcactgcgccatccggcagcaccatcccattaggaacaatggcattttcaatgactacatgctccccaatcgtcacatccggcattatgacggatgatgtaacagtcgtatgcttaccaacagtcacaccttgaaaaagaacggagtgagacacatttccatatacaacacaaccttcgttcacaagcgaatcttgaacctgcgcatcagatgaaataaattgcggaggctgatttggattgacggagtaaattttccatttgcgttcaaacagcttcagctccgagtcctcttttaacaaatccatattggcttcccacaagctctgcaccgttccgacatccttccaatatcccttgaacggataagcagaaagcttctttttctcttccaaaagcagaggaataatgtctttgccgaagtcgtggctagaataagggttttgatcgtccatctcaagatactgtttcaaaagcggccaattgaatatataaattcccattgaggcaagattgctcttagggaatttgggcttttcatcaaaatgtgtgatcgtcccatctggattggccttcatgatgccgaaccggcttgcttcctccaagcccacttcgatgacagagatggtcacatctgctttcttttcaatgtgataatcaagcattttgccgtagtccattttgtatatgtgatctcctgataaaatcagtacatactcaggatcatactgattcaaataattgagattttcataaatggcgcttgccgtccctttataccacttgacttctgatgactcggcataagggggtaaaaccgtcacgccaccattatatctatccaggtcccatgcactgccgatcccaatataggaattcagctcaagcggctgatattgcgttaaaatcccgactgtgtctatgcctgaatttgaacagttgcttagggtaaaatcaataatcctgtatttacccccgaaagatacagccggtttagccatattttttgttaatccgctgagacggctgcccttcccgccggcaaggagcatggctacacattgttttttcatctttttatctctcctctttttttaaccgcccgtaaaatcgagatgccgtaaggggggatggtcatcgtgatataacacggtttatgatgaagtgctccctttttagccgataatggctttttgttgatttgccctgagcctccatatgtttcactgtcactgttaagcacttcaatgtattgagtaaaaaaaggaactccaacatcatattgatgatagaccacgggtgtaaaattacaaatgatgacaagcgcctcaccgtgctttttgccataacgaataaaagaaaagattgattgttcgtcattatggacatcaatccattcaaacgattgtgcacgatggtcatgctcataaaggattttgcttttttggtaaaagcggagaagatcttgcgtaaaaacgctggctttctgatgcatggggaaggagtccaaaaaccaatcaagctgttctgtatctttccattcatcaaattgggcaaactctgatcccataaagatcaatttctttccgggatgcactgtcatatagcccagcaaaagccgatactgggcaaatttctgccagtagtcgccaggcattttattaagaagtgatttttttccgtatacgacttcatcatgagaaaacggcaatacaaaatgttcactaaacgcatatagtaatgaaaaagagataagctgatgacaatgccgcctttcttcgggcggcgtctccatgtatttcagtacgtcattcatccatcccatattccatttataatgaaaaccaagccccccttcctcaacggcacctgtcacttgaggccattctgtagaatcttccgcaatcatcatcacatggggatatgcctctctcatggtttgattgagtttttttaaaaactcaacagcatatggattcgtgtggcgttcatcctgatttggccaatacaagatattagccactgcatcaaccctaaatccatctatatgatagaattccgcccagtacaacgcattcgaaattaaaaaactatgaacttccggttttcccaggtcaaagtttgccgtgccccataaccagttctcccgatcacgttcttctttgtattcataaagcggttctccatcaaacatatagagtccatgtgcatctttacaaaaatgtccggggacccaatccaaaatgactccgatattttgttgatgacattcatcaacaaacttcatcagatcatgcggcgggccaaacctgcttgtcgggctgtaataccccgttccttggtacccccatgaacgatcatatggatgctcatacaccggaagcagttcaacatgggtaaacccatgctccttgatataagggataagcgtctgacttaattctttataggaataatgcctgccatcagaatgcttcttccaagacccaagatgcagttcataaatgaaaacaggtttttcatacagcgtcttagtcttctgtttcttttgccatttttgatcttgccagctgtacccttccaaatcgtaagtaagtgacgctgtgtttggtctgacttctgaataaatagcgtatggatctgccttcagcctgatctcaccgttattcgtcacgatttcatatttatatcgttccttttctcctaaacctggaataaataacgtccaaataccactatcattcactctgtgcatcacatgctcttctccagaccagctgttaaaatctccagccactcgtacttccgacgcatgaggcgcccacacacagaattcatatccgcttttgccattcagctcgcggtaatgcgagccaaacagctgatagctttcaaacagactgccttcgtgaaaaagataaacatcatgtgctgtcgggctggcagcggccatgtaatcatcctttctgacatcatagttttcatttatagtatttattcgaagaaataaaaaaaagccctttgctgaaagcgcttatacttatagacaattaacttcattttctgaagaaaaacgaaatatatggagatttttgtagtctgcttttaaaataaagaacaaaatctaagacatatcatgatttagaaaacaaaaaaaccttgcaggatatgcaaggcttctggatgacccgtacgggattcgaacccgtgttaccgccgtgaaagggcggtgtcttaaccgcttgaccaacgggccgataattattatacctgtaatcatatggcggagaaggagggatttgaaccctcgcgccgcttacacgacctacacccttagcaggggcgcctcttcagccacttgagtacttctccatttggctccacaggcaggattcgaacctgcgaccgatcggttaacagccgatagctctaccactgagctactgtggaatacaaaagtcatggtgggcctgaatggactcgaaccatcgacctcacgcttatcaggcgtgcgctctaaccagctgagctacaggcccatgacgatatagaaatggagcgggtgatgggaatcgaacccacgacatcagcttggaaggctgaggttttaccactaaactacacccgcaatttttatttggggcgattgatgggaatcgaacccacgaatgccagagccacaatctggtgcgttaaccacttcgccacaaccgccaaaatatattgataaatggtggctcgggacggaatcgaaccgccgacacacggattttcagtccgttgctctaccaactgagctaccgagcctaagtatttaaatggcggtccggacgggactcgaacccgcgacctcctgcgtgacaggcaggcattctaaccaactgaactaccggaccattttaaaatttggttgcgggggcaggatttgaacctgcgaccttcgggttatgagcccgacgagctaccgaactgctccaccccgcgatgattaggaatatgtatggcggaggaagagggattcgaacccccgcgggctttgacacccctgtcggttttcaagaccgatcccttcagccagacttgggtattcctccgtatagtggtggaccttgtaggactcgaacctacgaccggacggttatgagccgtctgctctaaccaactgagctaaaggtccattggtagcggcggaggggatcgaacccccgacctcacgggtatgaaccgtacgctctagccagctgagctacaccgccaaatatttttagaaatcaagtggagcctagcgggatcgaaccgctgacctcctgcgtgcaaagcaggcgctctcccagctgagctaaggccccaagaatggtcgggaagacaggattcgaacctgcgaccccatggtcccaaaccatgtgctctaccaagctgagctacttcccgatttcatatagatcatggcgcgcccgagaggagtcgaacccctaaccttttgatccgtagtcaaacgctctatccaattgagctacgggcgcaaaacttaatgccgagggccggacttgaaccggcacggtagtcacctaccgcaggattttaagtcctgtgtgtctgccaattccaccaccccggcgtggatggtatagttggagcggaagacgggattcgaacccgcgacccccaccttggcaaggtggtgttctaccactgaactacttccgcagaaatggtgcggatgaagggacttgaacccccacgtctgtaaagacactagagcctgattctagcgcgtctgccaattccgccacatccgcaacatgtaaatggtgagccatgaaggactcgaaccttcgaccctctgattaaaagtcagatgctctaccaactgagctaatggctcttcttacaagagacttgaatattatatcatataaaagtggtgccggcaagaggacttgaacccccaacctactgattacaagtcagttgctctaccaattgagctacaccggcatatatgtaaaaccgatatgtataatgaaaaatggtggaggatgacgggctcgaaccgccgaccctctgcttgtaaggcagatgctctcccagctgagctaatcctccatacttgcactaacgtgcaattgcttggcggcgtcctactctcacagggggacccccccgactaccatcggcgctgaagagcttaacttccgtgttcggtatgggaacgggtgtgacctcttcgctatcgccaccaaacaaattgagagtgttctctcaaaactagataacaggtgtgacatcattcaaaaatatggttaagtcctcgatcgattagtatctgtcagctccatgtgtcgccacacttccacctcagacctatcaacctgatcatctttcagggatcttacttccttgcggaatgggaaatctcatcttgagggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactatatttcgctcgccatcacagctcagccttatgggaaacggatttgcctatttcccagcctaactgcttggacgcggatatccaataccgcgcttaccctatcctcctgcgtccccccattgctcaaatggtgaggaggtggtacaggaatatcaacctgttgtccatcgcctacgcctttcggcctcggcttaggtcccgactaaccctgagcggacgagccttcctcaggaaaccttaggcattcggtggaggggattctcacccctctttcgctactcataccggcattctcacttctaagcgctccaccagtccttccggtctggcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcattggcattcggagtttgactgaattcggtaacccggtaggggcccctagtccaatcagtgctctacctccaagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcatgcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctaatcccgtttcgctcgccgctactcagggaatcgcatttgctttctcttcctccgggtacttagatgtttcagttccccgggtctgccttctcatatcctatgaattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactatgtgatatcttgtattactaattgaatgtgatgtctactgttatctagttttcaaagaacacgtttcgaaggaatgatccttcaaaactaaacaagacagggaacgttctgtttataagacccaaggtcttatattccgtataatatccttagaaaggaggtgatccagccgcaccttccgatacggctaccttgttacgacttcaccccaatcatctgtcccaccttcggcggctggctcctaaaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaagggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtaccgccctattcgaacggtacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgttgccttggtgagccgttacctcaccaactagctaatgcgccgcgggtccatctgtaagtggtagccgaagccaccttttatgtttgaaccatgcggttcaaacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaatggatcacaggttaagttcaccgcatcctgcggcgacacctgtgtgacctgcgtcgtgcagaccctagtttgactgactacgcacatcgctgtgcgatttttaaaaactgaattaacaggtacgttttgtcttgtttagttttcaaagatcatttcgttacttctcaatgaagcagctttactaatataacattcagcttcttttttgtcaacaacttttttcaagttgttttgaagcatctagtttgtgtccgctgtgcatcagcgacgtttaataatataacacctgtatttatttattgcaatagtttttttaaaaaaatctataaaacaaataaactataatcctcgccatgatttctaaagcgtgtgtatcatataagtttcttaaaagaacatatacatcagtcatgtgatcttgttgtttttttcgttttcttgtatagtagaaacgaactaaatactgatgaccacaaggggagcattaaagctgagagtgagcggtttcgttctgaccctttgaacctgttagttaacgctggcgtagggatgtggcaaagtcaaatgaattgcagatcgtaaagcagtgcgtggaacttttctcatccttccgcgtgctgcttttttgttgtccttttggttgtctgtcaatggaaggagatagatatgaatcaatctaagcaactggttcgccttattgaaattgccattatgacagcggcagccgttattttagacattgtctcaggaatgtttcttagcatgcctcaaggaggctcggtctccatcatgatgattccgatctttttaatttcgtttcgctggggtgtcaaagcaggtcttactacaggtttgttgacaggtctagtacaaatagcaatcggaaacttgtttgctcaacatcctgtacagctattgttagattacattgtcgctttcgcagcaatcggcataagcggctgtttcgcttcttctgtccgtaaagccgctgtatcaaaaacaaaagggaaattgattgtttcagtggtcagcgcagtttttatcggcagtttgctgcgctatgccgcgcatgtcatttcaggagctgtgtttttcggcagctttgctccaaaaggaacaccggtatggatttattctttaacttataatgcgacttacatggttccttcattcattatttgtgcaattgtcctatgtttattatttatgacagcaccccgtttgcttaaaagtgacaaagcgtaaaagtaacaatcccccagcgaattccgctgagggattgttcgttatctgttaagaagtgtttttaaagctgaaagatccggccagccaagacctacttctttcagccttactccggcaatttcaaagttgtcctccgctactctttcaggtgaataggcctgataaaatataattgagggattctgctcaataacccaaacaaacatacttgaaaatccatgttgaagcaaaaactccgctccttttgctaagagcgccctgcctgcaccttgccgctggcgctcttccagaagataaatagcgtataactcgccgtcatagccttcttgttcagagcgaataggtccaaatgaagcaaagccgaatactgaatccatttcgtcctgagcaacaaatactccttttaacgagcgacttttccatttgtcttcaaattccttatagttcaggctgtttaaataatcaatcgggataatttcgtggtatgttgtcctccagctgtctacatgcacttttgcaataccctttatatcctctaacttcgcttcacgtacagttaccatacggttctgtcctttccttactctgatttttggaccgttttggcttctttgatttcatttgttaattcattgatgctttgttttacgtttccttttcctgaaaagttctcaagcatttcttttacatcgattcccgaggatgcttttaaactttcttgcagacttgacattaagttcgtcgcatagctggttactttgtttgctccgcttgattcaccgcttcctcctgtatcgacaacggtgattttatcaatatttgaaagaggtgccgctgcttgtttcgcgtattccggaagcattttgacaatcatatcgaaaatcgccgcctgcccgtactgttcaaaggcggccgcaattttctcttttgcttccgcttctgcaagacctttcaggcggataacctctgcttctgtctctcctttcgctttttccgcttctgcttttgctagcccgtcaattcttactttttccgcctcagcctttgccattgcttcaatactgtacttcttggcatcggcttccgcgagctgtttggctttctcagctgctgcggactgctcaacagaataacggtctgcatcggcttttttctttacctctgagtcgtattgacgttcacggcgaagaatttctttttcttctagttctatttgtttttggcgttcgataattttaacctgcatttcctgctctgtgacttgctggcgcgctcgggcagtctctaaatcatatgcttggtcggcattcgcttttgccgtatcttgttctctgcggaattcagccattttgagctgattgattttttcagcttcagcgatttccgtcgcccgttcaagttctgatttttttgcgtctttatcggcttctgcccgcttaattcgggtttctttatcagcctctgctgttgcgatatcagcatcgcgttttacttgggcaattctcggtttccctaatgattcaagataaccgtttttatcacgaacatctttaatggtaaacgagacgattacaagtcccattttcgcgagatcctgtgaagcgacacgctgcacctcttgagagaatttttctctgtttttatagatttcttctactgtcattgagccgagaatggaacgaaggtggccttctaaaacctcccgcgcttcctgctcacggtcgtcttttgatttccctaaaaattgttcggccgctgtagcgatttctcctatagaaccgccgattttaataatcgcagttccatcggccattactggcactccttgttctgtatagacttcaggtgtcgaaacatcgagtttgcttgataataggcttagcggctctgcctgctggaagacgggaaggacaaaggttcctccgccgcggacgattttaatacggttgccgccttcatcgacatgaacatttttattacccagatagctccctgttacaattaacgcttcatcaggccctgctgtacgatacttcgtaataaacacagctattagtgcaattaataaaaagaatacaactccgatgatcattataatcggcattgtcatatcaaattcctccttttatgttaaatgggttcatgcggagtaaccgaaagaactccgtttttgacatctacgactagcactcttgtgccataaccgatctgttgattttcaaagctgatcgctgacttcgagatggtgccgcctatcccttcaatgaccacttcaccaaacccgtcaacaggaacagctgtaatcactttaccgagtcttcctctgagatcatcttctctatatgccaatgattcttctgcagatgataatggtaccagtacaaagatgtgaagcaataccaccagcatgatcgaaaggatgcaagataaaagcgcaatcagcaagcttgacagaggcaatacgagttcacctatatatccgtccgctgaaaaacatgtgaaaaatgagagcactaatgtcggattaagaaacggaatgccttctggcagccctgcaaatacatctccgaaaaacagaaataacagcgtaaggctgcccgcaataataagcgtataaagataaattgtttgtataggtactccaaataactccaatttcctcatcctttcttcatcaatgcattgatgaacggctgccgttaccattaatacgagacaccccgggaaaagtttcaaaattttaagataagtaacccatttgaagtgctttataaatgataattgcttatatatatggtaatgtcattttaggaggagatatgatgagtatctttaatgaagccagattagaaacgtggaacgaattgaaaggactttctgacgaaaagctgaatcaaaagccttctgctgaagaatggagcatacgggaagttcttgaccatttgaaaaaaatcgatatgaccgcacaaaaaatgttgaaggaacgtgtacaggacgctccgattaaagaaattgaagaaaaaccgcttgaggtagcacaggacagaaataataaacggaaagccccgagtcatcttgagcctgcgcatgattttatttcaggcagccaaatgaaacgtgagcttgatgtggtaagagagcagctgactgctgcgattgcctctctgaaagaagaagattttgaaagagtgcttccgcatcctgtgtttcaagagctgactgtcagacagtggatcgattttatcggccatcatgaaaaacggcacctcagccaaatgaaagaaattaaagaaaagatagaaagggcctgatttaatcagaccctttctgcttttcgtttgacttttcgctgataggaatgaacttctatttcatcacctgtgtaaacagcaccaggtctctccacaatacagacaacccctctaatgcccagtgcgtggcggacgaaagccggcgccagcttcggttggtccggataataagactgaatgacttctcccggctggatacacggatcattttcgccctcacacagcagagccgctccgctcggaaaaataatccggcttccttcttttaatgaagtaagatctggcataccgctgactgccacattcgccccgagccattccggcaaaattctcggcactcccatttttaaagcgatttcgttgcattcctctattgaaacaattgaaatttgtctgcggttgaaaatttcagtccctcttgaaaacattggttctctggctcccgcttttttggtcaggccaaaatgcaagtcgccggggatgccgccataatcaaaatcaagcttgtccatttgctttgttacgaagctttctgtatctgcgatatataagccttccgcttttgcagtcatacgcttccacatcagctggcaccttccttcttatctaaaatttccgcctatgcttcattatcccaaaaaatcccgctctgtaaaggagcgggattttgattataccgttttaggcgtaaggttaaagcagcgcttgtagatccagttgtatgctttttcatttaaatctctagggtttccgaaggtttgcggatctttcattgcttctttagacaagcgttcgatcatatcaggtgatactccctgctcttctaaagtcagcacttctaaatcttcgaccagatcatacatccaattgacagatgctttcgcagcttcttctgttgtcatcttgcttgtatcaataccgaacgctttcgcaatacgcgcaaacttctcaggatagcccttccagttgtattccatgacagggcccatcatcgccgctacacattggccgtgagcgactgggataataccgccaagcgtttggctcatcgcatgagccgcgcccgctgattcacttccgtaagaaaggccggcaagcatcgctgcctgcgccattccgtaccttgcttccagatcctctccgtcagcaaatgccctcttaatgtaatgagcggcatactcaatcgccattagggcaaccgcatccgtgattggctgtgcaaatttcattgtatagcactcaatggcatgggcgagcgcatcaattcccgtcatagctgttacatgcggaggcattgaaacatgaagctcaggatcaatgatggtcaagtgcgctgcaatcagcggaccgcccgtgttgaatttgaattctctttcttcatctgtgataaccgcccattgggttacttctgatcctgttccagctgtagtgggaattgtcgtcagcggaggaatgcggttttccagcggttttttcccatctgccgcttcataatcaagcacgcttccttcgtgagtcgcttctactccgattgcttttgctgtatccatggagcttccgcctccgactgccaccaaaccattacagttctcttttttgtaaagctcagatccttcattcaccagacggacaggcgggtttggctcaactttattaaagagcaccacttcaatgcctgcttctttaagtgattcgattacaggatcagcaacaccggctttataaatccctgggtctgtgacaaggagcgcttttgaaacgcccagtgcagctacttcctcacccgtatgcttgatggctccgattccatgcttaatcacagtcggaatttcaaatgtgtggaatttctgcatgctttctaccttcatatttaatgtcatcatcaatctccccctcttatgaattgaaccagttaaccgctgccggttttgtattacggtatacatgtttgacttctgtgtattcttcaaggcctatttttccaagctcgcgtccgaacccggattgcttatatccgccccatggcgcttgtgcaaagtacggatgaaaatcgttgatccaaacggttcccattctcaagcgggctgctacccgttcgcacttttcaatgtcttttgaccataccgctccagccaagccatagatggtatcattcgcaagctcgattacctcttcttcagagctgaaggtttcgactgtcaatacaggaccgaaaacctcttcctgaacgattctcatgtcagaattacagtttgagaaaatagtaggttcatagaaaaagccgttttgaagctcaggatcttccgggcgtttgcctcctgtctccagcttcgcgccttcctctattccgatctcaacatatttttctacctttgccctgtgctccgccgaaataagcggaccgctttctgtctcagcatgaaaaccgtttccgagttttatgcgttttgcccgtttgaccagctccgccaaaaattgatcatgaatggcatcctcaacaagcaagcgggaacctgcagagcatacttggccggcgtggaaaaatacagcgtttaaggcctgatcaaccgcaacttctaaatccgcgtccttgaaaacaatatttgggtttttcccgccaagttcaagggcgatttttttgacgtttccgcttgccgcccgcatgatttttttgcctgtttcaattccgcccgtaaacgaaatcaaatcgacgtctttgtttacggcaagctcgtcgcccactgtggctcccggtccaaggacaagatttgcgacaccttttggtacaccggcttcttccatcagcttaaagactttgattgtcgtcagcggcgtaatctcactcggcttcatgacgattgtgtttcctgcagccagtgcaggggcgattttccagctcgcttgaaggagcggataattccatggagtgatctggccgcaaaccccgattggctctctaataattttgctttctgaatcaggaatcggagatgaaatgatctctcctccatctttgtctgccaagccggcgtaatattgaaaaacattggcgatatcgtccatatcggccttgctttcttcgagtgtttttcctgtatcaagagattcaagctcagccagctcctcaagatcgcgtctgattaattccgcaattttcagaacaatttttccgcgttcaagcccggatagcgatgaccattctcctttgtcaaatgctctgcgtgcggctgcgattgctttgatggcgtcctctcgccctccctcgcttacagttgcaatttcttcttgattaaatggattgataatactgcggatctgttctttttcggcactgatccattctccgtcaatgaataatgtttgactcatataagcctccttgacgtaaataaagtttgttaaataaaaatttaatgtttttaacaaccttaatctaacatatggtttttaaactgtcaaagtcccattttgatttttctttttgacttttcctcatgtttcgttaagataaagaacataaagaaataacttaacgaatttaattttctaaaggaaaagagggtcagtatggatgaaaatccagaatttgcagctatagaacaggctcgggatcttgttattgactccattgctgaaacgatggatctttacggaattacccgcagtgtcgggattttatatgggacgatgtatatgagggatgagatgacgcttgacgaaatgcgtgaggagttgcaaatgagcaaaccaagcatgagcacaggcgtcaaaaagcttcaagacttaaatgtagtgaaaaaaacatttcaccggggcatccgtaagcatacatttgtggctgagaaggatttctttaaatttttcacaaatttctttccacctaaatgggagcgggaggttcaagtgaatgtagcagcgatcgaggaagctcaagctgatttacaaaaggttttatgcaaggaagatctcgatgaggatatcaaaaatgaagcactgcagttatatgatcagctggaaagctctaaagcttactatgactggctgaaacggcttgctgaatcggtgcagaccggagaaatttttaaatttataccgatcgaaacaaagtaaagcagaaaacgcctgggaaagcaggcgtttttttgatgtaactactacaaatttgaaaaatacgggaaaaacaccccatttacttccaaaatatttgatggtaattttatgtaggtaaaatttgtatttggcctttcagaggaggtgaaaagcgggcaggcctgtttaatttatcattttttagggggaattttgttatgaaacgcaaattattatcttctttggcaattagtgcattaagtctcgggttactcgtttctgcacctacagcttctttcgcggctgaatctacatcaactaaagctcatactgaatctactatgagaacacagtctacagcttcattgttcgcaacaatcactggcgccagcaaaacggaatggtctttctcagatatcgaattgacttaccgtccaaacacgcttctcagccttggcgttatggagtttacattgccaagcggatttactgcaaacacgaaagacacattgaacggaaatgccttgcgtacaacacagatcctcaataacgggaaaacagtaagagttcctttggcacttgatttgttaggagctggcgaatttaaattaaaactgaataacaaaacacttcctgccgcaggtacatatactttccgtgcagagaataaatcattaagcatcggaaataaattttacgcagaagccagcattgacgtggctaagcgcagcactcctccgactcagccttgcggttgcaactaatgtaaaagaccggttaacgccggtcttttttgcgttttaccctcccctttttctctaattcccgttatcttttttctggtttaaaatttaaattgacaaacactagaaacaggagtaaattcttgagtgttcaatttcatacagtctcttttaccgcttaatcaaacacgaacgggggaaccaacgattggctgttttattaacagccttggggtgaatcttactaagtaagagggggtactctgaatccctaatccgacagctaacctcgtaggcgtatacagagaggaggtctattatttggccattctttgcaatggtcttttttgcttcagaaacgttaattcactaagggagatatgaacattgggaagaattaaaaataagcaatttgccgtgatcggtctgggccggtttggcggcagcatttgtaaagaacttcatagaatggggcatgaggtccttgcggttgatatcaacgaagaaaaggtcaatgcatatgcttcttacgccactcatgcggtaattgccaacgccaccgaagaaaacgaattgctttcattaggaatacgcaattttgaatatgtgattgttgccatcggagcaaatattcaagcgagtacgctgaccaccctattattaaaggagcttgatattccaaatatttgggtgaaggctcaaaactattatcatcacaaggtgcttgaaaaaatcggcgctgaccggattattcatcctgaaaaagatatgggagttaaaatcgcacaaagcctttcagacgaaaatgttttgaattacattgatctatctgatgaatacagtattgtcgagctgctggctacgcgcaagcttgattcaaaatcgattattgacctgaatgtaagagcaaagtacggctgcacgatcctggccatcaaacatcatggagatatctgtctttcccccgcgcctgaagacatcattcacgagcaagattgcctggtgatcatgggccacaaaaaggatattaaacgttttgaaaacgaagggatgtagacaaaggtgacacttcaaaaggataaagtgatcaaatgggttcggtttacaccgcctcaagtgcttgccattggttttttccttaccattatcatcggggctgtcctattaatgcttccgatttccactacgaagccattgtcatggatagatgctctttttactgcggcttccgctacaactgttacagggcttgctgttgtcgataccggtactcaatttacggtattcgggcaaacagttattatggggctgattcagattggcgggcttggatttatgacgtttgcggtcttgatcgtcatgatattaggaaaaaaaatcggattaaaagaacgaatgctcgtccaggaagccttaaaccagccgacaatcggcggtgtcattggccttgtcaaagtcctgtttctgttttcgatcagtattgaattgatagcagcactcattttatccatccggcttgtacctcagtacggctggtcatccggcttgtttgcaagtttgtttcacgcaatatctgcttttaacaatgccgggttttcgttgtggcctgataatttgatgagctacgttggcgatcctacagtaaacctcgtgattactttcttatttattacaggagggatcggatttacggttctgtttgatgtgatgaaaaatcggcgttttaaagctttttctttacatacaaagctcatgcttacaggaacgctgatgttgaatgcgattgctatgcttacggtctttattttagaatacagcaaccccggcacgctcggccacctgcatatagtcgataaactgtgggcgtcctattttcaggcagtgacgccgagaaccgcaggcttcaattctctagattttggaagcatgagagaaggaacaattgtatttactttattattgatgtttatcggagcaggaagcgcatcaacggcgagcggcattaagctgactacgttcatcgtgattttaacatctgttattgcttacttgagaggtaaaaaagaaacggttattttccgccgttccatcaaatatccgattatcattaaagctttagctgtgagcgtcaccagtttgttcatcgtgtttttagggattttcgccctgacgatcacagaacaagcgccatttcttcaaattgtgtttgaaaccttttccgcattcggaactgtcggccttacgatggggcttactcctgaactgacaacagctggcaagtgtatcattattgtcatcatgtttatcggaagaattggtcctttaacgttcgtgttttcattcgcaaaaacagagcaatcaaatatccgttaccctgatggcgaagtgtttacagggtgatatcaaaaaaatccggcgtgcagtcgccggatttttttatgattcgatatgagattgattttgtcttttttcctgttccgcgatgatttcattatcctccgcgttatcacgggttactttttgtgtaagaatcgcaccaactgctacaagtatcataacagcgatgtaataacctttttcattgagttccaggttatcagcattatagagtccgatactaaacaaaaatactcccgcaaaaaaagtaaaataagctaatactgtaaaggcaaccgtgtttctgcgtctatatttctgcacctttgttccctcccgaaagcatagttaaaaagtgataacttccgtggaatattatacctcaaattccccgtaatggaacaaagaattaaaaataccagtaaaaagggcttaggttgcctcctttatttcaacagctgaatcatcaatccagccgataagtttatcattgatttggaattggtaccatacagactggcctttctgttttttagacacaacctttatgtctttgccgacgtaagattgggcagaggtaagccttatggaccgatcatcagtagagggcttggaccatacgtcttgaacggcactgtctttaatagaggcgtttaaatccacagatttgagggatggatttacctcatcgtactcatctaaatcgtatttttccacaatagcgctgattttgtcagcgtagtcagggtctgtagcatatcctgatgtttgcagggcggttgccgcttccttataattccctgcctcaagcaccggtttatacttctttttattccacgatgtgccacgaacgaacaattgggcgtgatcatccatagattcaaaaaacgtgctgtattttcgaaacttcgcgcgaatggtttttcttttccctttttcaacttcgtccgtttccatcgtgacatgatggcctttataattcccttttacgccaaaaaggttgttggccttagcagccagttcactgttcccccagtccgattcgagaatggcctgagcaattgtgatgctggggagaacatggtatttttcatacaaaatttgggcatgtccggacagactgtctataaatacttgctgttcatcgatttcttcagtttctttggatatttcaatcggttttgataaagttgtcgctaaaacaaacagagctagcggaatcgatacaaggaaaaatagtgaaatcaagagtttacgttttttaagttttttacgggccatgaaaaccttccttcgaattaaaagattacgaatgtaaaagaatctaccttttagaattttacttgcacttctaatatttttcaattctttagggataaagttgggaaaagattgcaaaataaaaaccttttcgctcaatgaaaaggtttttaccatgtttctatttttgtaaatttctgagtgcattacgatattccgtatcatttattactttatatgatttgacagttgccttcgacaaaccttctgctgaaacggccggtttttccggagctgttttcgctttatcatgtggtttatgtgccagcttgtgccccattccagtggcattcatacaaaatgacaggcagacgagcagcacgctaaggataaaagaaatgaagaagagatcatgataagcagtcatcatagaatcctgttccgaaccgctttgtctggcagcatcttttttcgtgaaaaagccgatgagaatgggaactcccatatagacaaacaatcttaaaaactgaacagctgtcattctcttgaccaaatcaggcagcgggcctcccatggcagctcccatcagccctgcggcgactgtcaggcctgttcccgctgcaagcatgataaacagtgccgcgaacatataaagagatgatcgatcctgtatatgcagccattgaaaattcacaaaaacgagaatgagtccgccgataataccgagcatccctggtccgactttatcatataacagagcgcttaaaatggccgcgatcgccactccgattaaaagagtcaagtttaaaaaaatgagatgctcctgagaaatatcatacatttgacggagcaagccttgaaaagcagacaggctgacagctaccgttatcgtccctgcagctatgatcaataagccaagcaccggttttggcagcagcatcagtttaatagatatgaaggggtttttcactttatattccacaatcaatagaccaatgagcaaacataacgtcaccccgaaaccaatccatacataacccgatgacagcccccatttttgcagaaaaatgaatgaaaccgctgaggctgcggcaaggaagacagataaaagaattcccgcacgatcaagcggctgttcttgatccgccgctccgtgatgctcatcatgaagaaagaaatagctcaccgcgacaccgatcagggacaaggtgccaaagatgataaacagccatctccaatgcccgcagcttgttgcaatggttcccaggattgtaccgatgataacagaaccatagaatcccccgatcagcacaagcagtgcatagttcctgcgttcaatcgggaatgacagtacaagcattggaatcataatcatcagcatgacgcctgttgccgccccctgtaaaaagcgccctgccgccatccatgcaatatcgcctgaacatgcgatgagcagtgagcctagtataaagacaggtaatgaagccagatagacgggacgcgcaccgaattttttcctcagcagcggtcctgccggaactaacaaggcaaaggccatattgccgatcaatatcgggtttactaatgtgaagacacttgttccaaccgctttctgaacaaggccttgaactgacgacaatgccgtgttagacatcaatcccggcccgaccgctaagacggcgagcaaagaaatcacccaatagtgttttgtcttcatgttgtcattccttcctatatgaatacatgcgaaacacatcattttttgaaaacaaaagaagctaatagattttgcataccattagctttcattctaatattctccctttcaggggaaatgatattattttattataattatgtgaatgaatgagcatataatcaaatattatttcaaatcgattgtgttttgtcaatggagtaaatttcaagcacaacatagaaagcttgaaagcttttccccgatattgtgtctagaactgcacttatgaatccctgctcgttccctcaagcgaattaaagcaggccgttttaatcctttcaatccactattcccactaataaactcgaataagttggtgataagacaacattttgcccccacatttttttgtgttcactgggcgtttgccgcctctaaattgtatatgggtaaataccatgaattaacctatgaaataccaatgtaaggaaattctaaatattccgggaggcaaaaacgaatggaactgtatgagtgtatccaagacatttttagcggcttgaaaaatccatcggttaaagatttagcaacgtctttaaaaaaaattccaaacgcagcaaaattaagtcaaccgtatattaaggaaccagaccagtacgcttacggccgaaatgccatctatcgaaataatgaattggaaattatcgtgattaacattccgccaaacaaggagacaacagtccacgatcatggtcaatccattggttgtgcaatggtgttagaaggaaagcttcttaattctatttatcgctcagccggcgaacacgcagaactctccaattcatactttgtccacgaaggagaatgccttatttcaaccaaaggtttaattcacaaaatgtctaatcccacatccgaacgaatggtgtctcttcatgtctactcccctcctttggaagacatgacggtctttgaggaacaaaaggaggtattggaaaattcatgattgacagataaactgctcactttgacttcgctcaactggaggattcagagaatgaatcttttcctcaaaacaaaaaaacccttatagaataagggtttacaggtatggagccaagggggctcgaacccctgacctctacgctgccagcgtagcgctctcccagctgagctatggccccgtatgtaatgtcatgtttattatagatgattttattttgaaaaacaagctgtttcctcttgaattgacagaaaaaataaggctcgtaaaagagccttattttcgacttacatcatgatcaaaagtaaaatcacaccgagaataattcgatagattgcaaatgggacaagtttgattttgttaatcagccttaagaagaaacggacgacaaacagtgcgacaacaaaggcacagataaagccgacgatgaaaaatggcatcagatccgagcttaagctgtcccaatgcttcacgaggcttagaaagctggctcccatcatgatcggcatcgccataataaacgtaaagtcggctgcagctcggtggtttaatccgagaataacaccgccggaaatggttgaacccgaacgcgagaaacccggccaaagggcaagacattggaataagccgacggctatcgcctgtttataggaaatgcggtcgagtgtgtctgtcgctgttttccgtttattgacccagtcagcaaaaagcatgaggattgccccggcaattaaaccgatggccacagttttaacggaaaataaatattcatcaatgtaatcttcaaacaaaaagccgagaacagctgcaggcacgagtccgacggcaatttgggcaatgcttaatttatgtccctgctcctggtcgcttgtaatattttttttcaagcccagtaagtttaaaattcggtctttaaacacgatagctactgctaaaatggagcctagctgaataaccaccttgaatgagttagcagcttcttctgacatcagattacttgatttaagccagatgtcgtctactataatcatatgtcctgtcgaagaaaccggcgcgtactctgttaatccttctacgattcctaaaatggcggctacaaacaattcccatagagtcatgattttgattctccccattagacatttatttttttacataacgggagcttcccataaatggaaagcccgtcttatataactataaacgaaaatcacactttatgccccggcgtattttcatttttttcttcatcgtataaatgtgaccgcattttaaaccagtcaaataaatgtgtcgtaatgactttggcaaccgcatagccgggaatcgcaagaatgattccaacaacgccgaacagcttgccggctgttaacagcagaaaaataatcgtaatcggatggatgtgaaggttttttcccataatttgcggagagatcagcttcccttcaatcagctgaacaatcgtccaaacgatcaccagcttaagcagcatgagcggcgatgtcactatggcaatgataatcgcaggcgtaatggcaatcgttggccctaaatatggaacgatgcttgtgcaagccgcaatgactgcaagcaatgaagcataatccagcccgataatcaaataaccgataaacagcaaaaacccgatacagaagctgacaatgatctggcctctgatataagagcttaaccgatgattcatttcgcttaagactgtgtatgtctgttctttcaattgcgtcggaacaaacttcagtatgtagaccggcaatttttttccgtcctttaacaaatagaaaaggataaacggaaccgtaacgattgaaatgataatctcagtcagggcgccgataaaattcccaacgccggtaaaggtactgttcacaattgtcgctgcctgatctgaaacctttgttgcgagatcagatatattgatgttcgtcgtttgctgggcctgattgacgaagttgctgccgatcagctgtttcgtctgattttcaacgatatccacatatcttgggatgttgtcgattaaactcataatttgttcttttaagaagggaatgatcgacacgattgtgatcgtgatcagcccgataaccaatagatatagcagcaatatagaatagattcttcttattcttcttctctcaaggaaatcgacgaccgggtttaacagataaaaaacaatgcctgtcaaaataatcggaagtgatatcgttttgagcaaaacaataatcggggtgaaaataaatgatgtttttgtaaatactagaatatttaaaccaatcagcagcagcacaagcaaaaataaaacaaacttattatccaagaagaatcgcttgaatctgccgctccatgtttgcaacgtctccactatcgttcctccgtcatacatagtttaattaaattgtacactatcgtccctataatgaaaaataaaaaccgttaattgctggaaaagctttcacggttttaacattctatttatatctatcatgtgattttgttctttttaagctataatttagctatatcatgcaaaaggagcgatacgagtgatacgttttgcaataataggaaccaactggattacagaccgctttcttgagtcagcagcggatatcgaagattttcagctgactgctgtttattcaagatcggctgaacgcgctggcgagtttgctgctaaacacaacgctgcgcatgccttctcagaccttcaggaaatggcggcgagcgattgctttgatgccgtatacatagcgagcccgaacgctcttcacaaggaacaagccgttctctttatgaaccatggcaagcatgtgctttgtgagaagccgtttgcttcgaatacaaaagaaacagaagagatgatctcagcggctaaggcaaacggcgttgttctcatggaagcaatgaagaccactttcctgccgaatttcaaagagctgaaaaaacacctgcataaaatcggcactgtccgcagatttaccgcaagctactgccagtattcctcacggtatgacgcgttcagaagcggaactgttttgaatgcgtttcagcctgagctttccaatgggtcattaatggatattggcgtctattgtatttatccggctgttgtgttgtttggcgcgccgaaggatgtaaaagcaaacggatatgctttatcctccggagtggacggagaaggaactgtcattctgtcttacgacgggttcgaagctgttctgatgcattccaaaatctctacttcctatgccccggctgaaatccagggtgaagacgggacgattgtaatcgatacgattcaccggcctgaacgtgttgaaatccgctaccgggacggccgccttgaaaacatcgcgatccctgatcctaaaccagcgatgttctatgaagcagaagaatttgtcacgctcataaaagagaataagctggaatctgaagaaaatacatttgaacggtctttgaccactgcaaagattatggaagaagcaagaaagcaaatggggattgtataccctgctgatcaagcttaaaaaaatccgcccgcgtgcaaatgccgcggcggattttttattaggcaatcggagaagatgccttcctttttaaaagcacctgttgctcatattctttgatgtcatgaagccatgcctcttttaccggaacgcccatttgctcacagtaggaatcccagatggctccgaaaggatatgttttgaattcctccatcagggccagcctttctgtatagcggccctcttcctgcaattgttttaaatatccgttcgggagaagcagggcatacaataaagctttgatcatatttctcgttccgatggtccaggcggctacacggttaatgctggcatcgaaaaaatccagaccgatggcgaccttctcaagagcatgatttcgtacaatttcaagagcgatttctctcaattcatcatccaaaaccactacatggtcgctatcccaacgaacaggccgcgatacgtgcaaggcaagcttgtctgtgtaaagcagcatggacgagatcttgtttgataccgtctcagtcggatggaaatggcctgtatcaagtaaacaaagcttatgattcgtcaaagcataagctaaataaaattcatgagatccgacaacatatgattcggagccaagcccgaacagcttgctctcgattgcatcaagattgtgttgttcactgatctcctctgcgaagatccgatccagtgattcttttagtcttttacgcggtgtcagcctatcactcgggatatccttatagccgtcgggaatccaaatattcgtcaagcaaggtgttcctaattctttcccgaagtattccccgatacggcggcaagcgatgcaatgcctgatccaaaattctctgatatccggatcagggtgtgaaagggtgagtccgtcagccgctttctcatgcgaaaacaaggttggattaaaatctaaaccgagaccaaggttttttgcccatttcacccagttttcaaaatgctgcggcttcaattcgtcacgttctaccgcttccctgtttgtttctgcgtatatcgcatgcaggtttacgcggtgctttccaggaatgagagaaagagccttctccaaatctcttcttaattcttcaggagtttgcgcttttccgggataattgccagtcacgtcaattccgcctgaaagctcgcccttatttacttcaaagccttcaatgtcgtcaccctgccagcaatggatcgaaatgggcacttgctctaattgccgaagcgcctcttcaacatcaattccccatttttcatatgcctgttttgcactgtcataattggcttttatggtcatacggctctctccctttatcagttttttaatccaaataaaaaacttcctttagatctatcgaaacaggactgaaatccgaatttgttttcattaatggcgccatcgatttccaccatcttcggcaaacttccgtgtccgccatctttctccatttctcttcatcctctatttctaaatatgcaaaaagcctgcctgtttcctcgtctagaaaaatggaataatggtgtgctccatgagctttgagtgcttctgccatctcaggccaaatgtcatcatgccgctgtttgtattcttcgtacttgtcttgatggacaaacatgatactggcttttcttttcaaaccttttcacctcttcatcatttagatagcgctttcaaaacagtttgctgaaatgactgaatgatcgtgcttctgtcaatgtctttaggtgtaaacactttgatcggaaaggaatttctgacgacttgccgggcttcttttatgtctttgacttctttggcagcaatcatttgcatcaaaagatttccggtggcagttgcctctatcggccctgcatataccgcttttccactcatgtctgccgttaattgatttaagaaatcattccgggctccgccgccgatgatatgaaattgctcgatcggtttttctgtgattgtttcgagctctttgatggctatcgcatagatgatggctaaattgctgtagatgcagcaggcaagttcgcctgcagtgcgaggagtcttttggcgggtttgtctgcaataatgttgtatttcctttatcatgttttctggattcaggaaacgtttatcatttaagtttataaattgctggaatggttctgtttttttggcttcttctgcaagctgctggaaagagtaatctgcttgtaactgttgtctgacttcttgtatcacccacatgccgataatgtttttgagaaagcgaatggtgttgtttgcgccgcgttcatttgtatagttgttttctaaagcaagatcagttattatcggtgttttgttttcaaccccgattaacgaccatgttccgctgctgatatacgcccagccatcatttattcctggcgctgcaatgacggccgaggccgtatcatgtgttgcgactgtcatcaccttgcacgccgggagatcataatccgggaaccactcatttcttagcttcccgagttcacaccccggttcagtcagcggggcaaattgctgttcctgaacggacacggcttcaagcaattcaggatcaagatttcccgttgaggcttttaaaagctgtgttgtggacgcatttgtgatttccgttacagcttttccggttaaacaatagcctaaataatcaggaatcatcataattttgtctgtctttatcagcagctcacggtcttcctcatacaattgatagatcgtgttgaaaggctgaaattgtattcctgttttttgataaattgcggcttttgagagggtatgttccagtttgtctattgtgtgatctgttcttctatcacggtaggagattgcttcccgcaaccgatcgcctttttcgtccagtaagacataatcaactgcccatgtatcaatgcctacggtgcagtgttcatacccaagcgtctttactttttgcagtccttgcaggatttgttttagcaaatgatcaatatcccaaaagcaatgcccgtctctttgactgaaaccgttagcgaacctgtgaatctcttgtatgtcaagcttcccttcattcagttcacctaccatgattctcccgcttgatgcgcctatatcaatggcagtataaatcatcctttcaccctctcttcgaaagaggaacagctgtcaccttcacctttttgtcctcaagagcttttaccgatgccggatcaagtccagaatccgtaataaggcggctgacatcttgcagcgaggcaatatgtgaaaactcgcggttcccccatttgcttgaatcggccatcaaaatggtctggtccgacctttcgatcatccgttttttgagcagcgcctgccactcatttgaatcactcatcccgttgtgtacgtcaaatcccttacatgacagaaaggttttattgacatgataggtctcaagtgaacgctctgctaacggaccggcaaatgataatgatttttccagcaaaatgccgcctgttgaaatgactgatatgttttctttattgctgagttcaatagctgctttcattgagtttgtaatcacggtgagctcaatgtcagggagtatttttgccatgtaccaagcggttgtgcttgcatcgagaatgattcggtctccgctttttacatatttggccgcttcgtgagcgatggcttttttttcgatgacattcgtgatttcccgttcagaaaaatgaatttctgattccttctgctgaatactgaccgctcctccgtggctccggctcagtttatgttctttttcaagcttttcaagatcacgccgaatggtttcctctgtgactgaaaatatgtcacttaattcggaaacgcggatgcttgaacgcatatttactatttccactattttttgctgccgttctgctactagcatcggtaacgcccttcctcatatcgtagtccgtcttatattttttatcatagcatatttctaacgcgtaaaagcagcagggacgccgccgtctaccgtgatcatgcagcccgttgttttttcggctttggaagaagcgaagaatgcaatggcttcggcaatatcctccgggtaaatattgacgagcaatgctgtccgtttccggtaatgttcctccagctgatccggttcaatcccgtacgccgcggctcgttcctcccgccagcttgaaccccagattgccgatccttgaagaaccgcatcaggcaaaacagagttgaccctaatgccgaattctccaccttctgcagcaatgcatcttgctaaatgggtttcaagcgccttaaccgagctgtaggcagaggcgtttttgcccgcataaaccgaatttttcgatccgacaaataccatgcttccgcctctattttggtgtttcatctgtttaaacgcttcacgggctacaaggaaatagcctgttcctaaaacattcatattaagattccattcttttagacttgtttcgtcaaatgggcttgatgtggccagcccggcattattgacgacgatatcaatgccgccgtaagcaagcgccgctcgttcaaaagctgattgtacgtcttcctcctttgtcacatccattttgacagccattgcccgtccttctccgtatgcatcgtttatttccccggcaattttctgtgcaccttctatattcagatcagctacgatcacgtgccctccctcagctgcaaatcggcggcatgctgcactgccgattccgccggctcctccagttatcaacgctacttttcgggaaaattctgcttccggcggggccagcgtgagtttatatagttcgagcggccaatattcgacatggtaggattcattttcatgtaaagaaacaaattgccccagagcggttgctcctttcatcacggcgatggccctccgatataaagccccgcttactttagacatggcataactttttcctgtattcaccattccgattcccggaatcaatatcacccgtggggaggattcaaagatttgatccccatcctgctgatttcgtgtaaagtaagcctgatactctgatgtaaaggtctcgactcctgacttgatcagatctgcaagcttgtgcacatcttgagtttccggattccaatcaatgtacagcggaacccgttttgtgtgaacaaggtgatccgggcatgccgcaccgatttgcgaaagtgctggcgcttggacactgtttacaaattccaagacatcgtcatgatcatcataggaaaggatcattttcttttcttcacttactgctcctctgatcacaggcatgatgcctgccaagatttgttttcttttatcctccggcagcggctgataccttttgcctccgaatacctcatgctgattgatacgatcgttaacatactgctcggcttcttgaatgatggatatcgttttttgataacatgtttcagacgtctctccccaagtgactaagccgtgtttctccattaatataagctcggcgtggggattgtttgctacgccttcagcgatcattttagacaaagtaaatccaggacggacgtatggcacccatacaaaccgatttccgtaaatgtcttcagcgatttgttttccattatccgcacagcatatgctgataatcgcatctggatgggtatggtcaacatgtttgtatggcagaaaagcgtgtaatagcgtttcaattgaagggcggggatgtttgctgtctatcatacaatgagacaggtagtctaccatttcttcatctggcatttggtcccttttaatcagcgggcggatatcatctaatttcaaaccggtaaagttatgcgctttcattgttgccaaatccgaaccgcttccttttacccacatgacttctatttcacggcctctaaaatccttttccgttgttttcatagatgtattccccccgccccagttgcagacagtgcggtctgacccgatcagattggacctgtacaccaattcctctacacctttaggcagccgtgcagctcgctctgaatcccatatatgtttcgccatatttgatattcctccatccccttttatttgtatccgttttcattatatatgatttctgtttgtttttgaattgtttttgtttatttttgcttttaacaaaaaagaaagcagcagatatgccgctttcttgtttcattatgattctattttaaatttcttcgtaatgtcctgaagttcttccgccatgtttgccaacgtttccgctgaagagctgatttcttccatggacgcaagctgttcttccgccgaagctgcgatatcctgaatgcctgctgagctttctttcgccactgcagaaatatcttcaacagcacttgacacttcctgtgatccggctgacagttgttcaaccgtcgcgttcaagttttgcaattcgccggaaatttgggttgtcatctcatagatttgtttaaagctttccgctgtttgatccgtaatctgcaagccttctttcacttcatgattcacggattggaacattgaaagtgaggtgctgatttccctgacaatctcttgaattaatccttcaatttccttggcggagtctgctgattgtacagcaagttttctaacctcttccgcaactactgagaaacctcttccgtattctcccgctcttgccgcctcaatcgcagcatttaatgcaagcaggttggtttgatcagcaatgccattaatcacattcaagatgcttgtgatatcttgcgattttgtttcaaggcccttcacaaccgcttccgctttttgaacggattggtcaattgttttcatctggccgactgtatgctccaccagcttttctccgctgcccgctgcctcagaggactgaatcgatgatttcgtaatggttgaagaggcctgagccacttttgaaatcccctcgttcatttgagaaagatgatttgagcttgtttccagtttctcgctttgtgcctcgttgccatctgagaattgttcgatggcaagtgtaatatgttcagttgccttgctcgtttgggctgcgcttgccgtcagctcctcagaagatgaagcaacgttttctacagacgtttgaataacgccgattacagaacgcaatgatgcagacatttcattaaagctttcgccaagctggccaaactcgtttttcgagtgaatgtcaatgacttctgtgagatctccactgctgatttttgcagacgttgagacaagttttcttaacggcttggtgatggcacggataatatagagaatgagtatgccgccgattacaattgacacgcatagaatgataaccgcagtgttcagcaccggacttgaagcatcttgcaattcactgacaaaatatgtgcctgcgattttccagccagtcagtttatttgtcgtaaaggccattttcttttctttgccttcgaatatatattcaaatgagccttcttttttggaatatacttggtttgtccaatcgccggatccggttgtccccggcttaattgtcggatgggcgatatattttttgttgccagtcgtaataaatgcaaagccttctttaccgattttgattctttgtgatgcagtaagcacttcatccaggtttaaatcaagcgctataacccctgaaccgtcttttaattgttttgaaattgtgacaacgatatctcctgtcgcttcatcagtatacggttctgagaaaacagcttgtcctttttccgcaaccgcctgtttgtaccagtcacgtcctgtcggatcgaaacctttcggaacaccgctatccggatatttataaagcttcttatcttctgaagcagcatagattgcgcctacatcgtcgttaagtgtcgtgtactgcttaaatttctctttcagtaatgttttgtttttgcctaacaatatgtctttatcgactgtctcactataataatctattgcttttactttatcttctaatttattttgcagcgtactgtttagttcttcaacatttcccttcgcactgtttatgagctctctgtctaacgcgttccaagctgattgataactgaaatatgctaaaaccccaaccggcaaaataagcactgccagaaacgcagcgattagcggtttgctgatcgatggctgtttgatccaatgtatgaattttcccattcttgttgactcctcctttaagataaatctaatatcgtcaaactaggataaaaggtttaataaaaaaactaaaaaaaacacccaagcgtaacaagcttgggtgttaaggcttattattcgattttgaatcgtttggtcatatcgcgaagctcttccgccatagacgaaagggtctctgcagacgagctgatttcttccatggaagcaagctgctcttcggctgacgccgcgatatcttgtatatgcgctgaactttcttttgaaatcgatgcaatgtgctcagacgctcccgaaacttcttcggagctggcagaaagctgctgaaccgtcgcactcatattttgcagttcgccggcgatttggttcgtcatttcagaaatgcgtttgaagctcatttctgttttatctgtgatgtcaagtcctgtctgcacctcttgattgacagattggaacatgccgagtgatgtattgatttccttcacaatttcgatgattaatccttcaatctcttttgctgaatctgctgactgtactgccagttttcttacttcttccgctacaacggagaagccgcggccgtactcgcctgcgcgcgctgcttcaattgctgcgtttaaggcaagcaggttcgtctggtctgcgatgccattgatcacacgcaaaatgtttgtaatatctttcgatttcgtttccaatccgcgtacgacttgctccgcttctttaacggacttgtcaatgacattcatttggccgacggtttgatgaacaagcttgccgccttcacttgcaatttctgtcgattgaacagatgaatcagtgatcacttcagaagcttgagccatattcgtcaacccgtcattcatttgataaatgtgctctgctgccgtttcaatgttttcgttttgtttttcattgccgttagaaaattgttcaatcgccaatgtaatgtgctctgttgccttgctcgtttgcgcagctgatgcagtgagctcctcagaggaagcggcaacattatctacggaatcctggatggcgtgtatgagagaacgaagtgacgacgccatattgttaaagcttttgccaagctcgcccaattcatcttttgaacggatatcaatggtttccgtcaaatctccctcgctgatccgcttagaggaaccgacaagctgtttcagcggtgttgtaatcgaccgaatgatcaaagtcatgacgataatccctatgataatagctgcggccaagacaattaaagcaaggtgtaggacaggctgggctgcctcatggatttcatccaaatacatggtgccgccgatcttccatcccgtcaacttgtttgtgtcaaaggccatttttttcttatcgccatccatggtgtattgaaaatcgcctttatcagcactcaacatcttatcgagccagtcgccttttaattcagttcctgatttttcattaggatgagcgacaacttttttgtccttcgtcatgataaatgcgtagccttgtgtgccgatgttgacttttttggttgttttcagcagattttcaatggtcatgttgattgcgataacgcctgaaccatcttttgtctgctgggcgattgtcacaaccatcgtatttgtcgacgcggttttataagggtctgtgatcacgactttccctttatttgcaaccgcttttttgtaccagtcgcgttcaaccggattgtagccgcttggcatcggaagatccggatagcgggtaaagtgcccttttgtgtcacttgtataaatggattctacatccttgttaatgctgatatattgtgagaatttctctgcaatgcttgcattgctttttgcattgtatttctcttttgtcagccattcgctgaaataatcagcactgttttctttttcgccgatgctggtgttaatgatttcgtttaattgctgtacattttccaatgcgctccccatcatctgtctgtcgagtgagctgctagccgattgataggcaaagatcgccaatataacaaccggtatgatgaggatcgacagaaaggaaacaagaagcttccgtgtaattgatctttgttttatgagttggagtatttttttcatcattcatttctccttttttatgctacccttcatatcggctggaaatgggtaaatatatacagcaaaaaagaagaaatttaacaaaagtaactaatttcccataaataaatagtattttagacctattatttatctactttaaattgttttgtcagatcacggagttcttcagacattctttcaagcgtcagtgcagatgaactaatctcctccatggatgccagctgttcctcagctgaagcggcgatatcttggatgccatccgagctttccttagaaatggcagtgatatcatttgaagctgcggaaatttcttgagctcccgatgacagctcctcaaccgtcgcattcatgttttgcagctcggaagcaatttgattggtcatttgcgatatatgtttgaagctctgtttagtttcatccgtcatgacaagccctgtttcaacttctttgtttacggactgaagcacgttcagtgatgtgtgaatttcttttactatttcactgatcagcgattcaatttcttttgctgagtcagccgactgtaccgcgagctttctcacttcctcagcgacgactgaaaagccccggccatattcacccgctctggccgcttcaatggcggcatttaaagccaaaagattggtttgatccgcaatgccgttgatgacacgcaaaatattcgtgatatcctttgatttgatctccagccctttcaccacttgttccgctgattttacagaatggtcaattgtgttcatttggccggctgttttctggacgagtgtctcccctttacttgacacttctgttgaatctgcggatgtttctgtaatcactgctgcagcccgcgccagctctgccaatccgtcattcatttcattaatttgttcggttgtcgtttctattttctcgctttggctttcactgccgtttgaaaattgctcgatagccatcgtaatgtgctcagtggctctgcttgtctggtctgccgatgcagtcagctcttcagacgatgaggcaacgtgttctactgagtctttgatcccgtgaatgagcgagcgaagcgagtgtgccatatgattgaagctctcgctcagaacgccgagttcatcttttgaattgatttcaatcgtttcggttagatcgccttcactaattttttcagcggatgcgacaatgcgtctcaatggctttgtgatggatcgaatcacaaaataaatcgccgtcattccagctgcgatggcaatcgccagaacgattgaagccatgatcagaaccctgcttgcagcatcgtgaatctcgtttgcatacatcgtgccgctgattttccagcctgttgtttcgcttgttgcaaatgccatttttttctttttgcctttgtacgtatattcaaagtccccgcttttatccttgtagagcttatcaacccagtccccttttagctctgttcccgctttttctccggagtaggcgatgactttcttgttttggctcaaaataaaagcatagccttcttttccgatattgattcctttcgcggtagtgactaagtcatcaattttcatatcaatggcgacaacacctgacccatccaccgtttgacgggcgatggtgacgaccatttttcctgatgaaatcgattcataaggctcagtgacaattgttttgcctttattggccattgcttctttgtaccaatctcgttccaaagcattaaagtcacttggcatgtcagcgtacggataacgggtgaattccccgtctttgccgcttgaaaataccgcagcgacattatcattcatttggataaattgtttaaattcctgtttcagctctgttttctttttatcctgaaatttttcttctgtagcccaatcgctgaaatatgcgaggcttttttcagtcgtgctgattttatcatcaatgatgtgatctaatatctgaacattttcctttgcgctttgcgtcatctgtacatcaagtgaggcaactgctgattgataagcgctaaccgaaagggcggttatcggaacaattaagatcagcaggaaagaaataataagtctccttgcaattgatgatctgcgaatagtggtgagtgtttttttcatttccttttgaaccttctttcaataatttacaaattatatcggcggatcttcctttaaattacattgaaaatggaggaaaaaatgaaaaatagttctaaattcacctgttaaactaggactttattattgtttaccatataaaaaacagcgctttgatagcgctgtttttcggcttttactcgattttaaattgtttcgtcagatcacgaagctcttctgccatctgcgcaagagtggtcgctgaggaactgatttcttccatggaagcaagctgttcttcagctgatgcggcaatgtcctggatgcttgccgagctttctttcgacacgtctgcaatgccgctgactgctgctgaaacatgctgtgaacgatctgacagctgctcgacggtggaattcatcgtctgcagcttgcccgcgatttcgtttgtcatgctgaaaatgctctggaagctttcttttgtattgtctgtgacaacaagtccggactgtacttcctgattgacctctttaaacatgtgaagagaggtttcgatttctgcgacgatttcttggatcagcttttcgatttcttttgctgaatcggctgattggacagccagcttgcgcacttcctccgctacgacagagaagccgcgtccagactctccggcacgcgccgcttcaatggctgcatttagtgcaagcagatttgtttggtcagcgattccgttgatgactctcaaaatgcttgtgatgtcttttgattttccttctaagcctttgacaacagcttcagcctgctgaacagattgattaatcgagttcatttgtccgactgtctgctgcacaaacttctcacccgttccggcgatttccgttgattggatagatgcctttgtaatatctgacgatgtttgtgagacttgctggagtccttcattcattaagttcagctgatgagagctggattcaaccttttcgctttgctcctcgtttccgtttgagaactgctcaatcgccatcgtaatatgctcggtggctttactcgtctgcccggcagatgcggtaagctgttcggaagatgcggccacattgttcaccgagtcctgaatagcactgatcagcgagcggagagattgtcccatttcattgaagctttccccaagctccccaagctcatcctttgaatggatttcgatcgtttcggtcagatcccccctgctgatcgttttcgatgattgaacaagatgttttaacggttttgtaatcgaacgaacgataaacagaattaaaattccgcccgccacaatggaagcaatcagcacaatcattcctgtagtcagcacagactttgaggcatccttaatttcatccatatacattgtgccggctattttccaaccagtcagttcgtttgtagtataggtcatctttttatcttcgttattaagagtatactggagttcaccgctgtcattcgcatacattttggctacccagtcgcctgaaagcttttctccagccttatggttcttgtgggcgacataggttttgttttttgttgcaatgaaagcataaccttcttttccgaccttgatttgtttcatttgttctaacaatttatcaatggtaatatccatggcgacaacgccagatccgtccttcagctcctgtgcaatggtaatgaccatgcttccgtcactcgcagccacgtaaggatctgtcacgacaatttcaccgccggccttcatcgcatcctggtaccaaggccgttgtctcgggtcgtatccttccggcaatttttcttttggcgcttgtacataagtgccgttatctgcgcccccataaattctggctactccttgattaatagatacatattgtgaaaatttagctttgatctcttcttgattcgatttccctttgaatgcggaccttttaagagattcactgaaaaaggtgactgctttcgctttttctcccagatcatttgtaacagttgtattaaatgtatcgacactgtttttcgcatttcccataatttcctgatccagctttccgctggcgcttcggtaagagctaaattctaatataagaatagggataatgagaatcgcaataaatgagacgattaatttctttgaaatagacggtttcttaagccaattgataaaagtcttcatgtccacttgctccttcaggtttgatacagtatatatcggctgcttaaaaaagttttaaaataaaaaatggaagaagttctttttggctgtcttctgtcgttttaactttcattgcccaagctctttgcatatcttataaaaaacaaggggggctaaacatgattattgtatcaggacaattgctccgtccccaggatattgaaaattggcagattgatcaaaatctgaatccgctgttaaaagagatgattgagacgcctgttcagtttgattatcattcaattgctgaactgatgtttgagcttaaactgcggatgaatattgtagcagcggcaaagacgctgcacaaaagcggggcgaagtttgccacttttttaaaaacatacgggaatacaacgtattggagggtttcaccggagggcgccttggagctgaaatacagaatgccgccttcaaaagcgattcgtgacattgctgagaacggcccgttttatgcgtttgaatgcgcaaccgcaatcgttatcatttattacttggccttaatcgatactatcggagaagataaattcaatgccagctttgacagaattattttatatgactggcattatgagaaattgccgctctatacggaaacaggacaccactttttccttggagattgtttgtattttaagaatcctgaatttgatccacaaaaggcgcaatggagaggcgaaaatgtgattttactgggggaagataaatattttgcccatggtcttggaatcttaaacggaaagcaaattattgataagctgaattcttttaggaaaaaaggagccttacagtcagcctaccttctgtctcaggcgaccagactggatgttccgtctcttttccgcatcgtccgctaaaaagccccatcgcctattttccggacgatggggtttcaaatgcctttcgttttcgatagaagggggctgtgccgaaatattggttcgcagcccactccattttttcaaggtcatttcttgtcacgattggatcctggctgctccatttgataaagcggacaaaatagtagcctttgataggaaccattgtaacttttgagtgaggccagccttcaaatacaaactcaattttccctctttttttataagagtattgaagaatgttcatatttgtcacctcagtttatcaagttacgttcggcaaagctcggtacgtttacatccattgattgactatccctcatgcatgctttcctgaaaacaaagggtgaggcgcgtgtctctttccctcgctttttatttcgcatatggacgaatgccaagcgcgccttcattcgataaagcggcagccggggcgggtgtgacaagccctccggctatcggcgtttgttcagcgatcatgcttttgtcaaaaaaacagcctattatcccatcattttgatatagcatgtccgggtgcgagggccgtcaaattcgcagaaataaatgccctgccaagttccaagaatgagccggccgttttccacaatgacatgctgtgaagctccgactgtactcgacttcatgtgtgcagctgtattgccctccatatggcggtccagctcatgttcccacggatatacctcatcaaaccttctgagcatatcttttttgacgtccggatcggcattttcattaattgtaatgcccgcagtcgtatgcggacagtaaatcagcgctgcgccgctcgttatacctgtttcttgaagaaacgcttccacctcccgggtgatatcaatcatttcatctcgtttggttgttttgatttgcagtgttttcagcatttgtttctcctttcgtttgtccgctctcatcgcttaattcgttctgtgttcttttttttcctgttaaaccgctctcataaacccgataaaacaaaaaaactccagtctaaggctggagtttagcaccatagatatattcttgcttcatacggctttaagagtactgatgtcatatgcttgtgcggctctgtttcaatatttgacaagacgagtgcatctgatgacaatggcaatccagagtgcctgaacaacgccggtgttcctgtcagattggccgcaatcagtgcagtatggctctcgtttttccgaagatatgcaaagatttgctgatcttccggtaaaatgagctcgtatgtcccgttaataaaaacatcatatgtttggcgcagcttgatcaagcttttgtaaaaatggtaaacggatgttttatcgtttttttgcgcctcggcattcagccatttgtaattctcattgattccgatccacggtttggcctcagaaaatccggcgtatggacctgcattccattgcatcggcgttcttgaattgtctcttccctttttccagacaatcttcatcacatcctcgtgtgatgtgcctttcgctgtttttgtttcatacaggcgtttcattgcgacatcatcatagtcctcaatagagggaaaagccacgttcgtcatcccgagttcctgtccctgataaataaacggtgtgcctttcatgagaaaataaacagcggaaagcgcttttgcactttctttcaggtacactccgtcgtctccccacacagaaactgaacggggctggtcgtgattctccataaacaaagcattccagccgatcccttccagactgtcctgccagtcagttaaaattcgtttaaatgcaacgatatcaatactttcattgatctctacatcccacaggccgagatgctcaaattgaaaaatcatgctgaatatgccgtttttttctccagcccaatcagctgcttcttttgcagcgacgccgtttgcttcaccaactgtcataatcggatagcgggaaaatgtgttttccttcagctctgttaacaaatccataatgccgtcagcattcatatgataaggaaaggaagggacatagtccaatccctttggattcggcatgtcgggaagcccttcttttttcttaatatgcgtaatggcatccacccgaaatccgtcaattcctttatcaagccaccaattgatcatgtcataaacggcattcctcacctgttcattttcccaattcaaatcaggctgttttttatcaaaaaggtgcagataatactggcttgtcttttgatcatactcccaagccggcccgccgaaaatgctttcccaattgttgggcgcttttccgtttttgccgtctttccaaatataccagtcgcgcttttccgagtgtatggatgaacgggattctatgaaccatggatgttcgtcgcttgtgtggttcacaacgagatccataatcagcttcatccccagatcatgaatgtcaccaagcagttcatcaaaatcttccatggtgccaaactcgcttaatatgttttgataatcccggatatcatagccattatcagcattcggtgagtcatacagcgggcaaatccatatgacgtcagcgcccagctcttttatgtaagaaagcttggatctgattccttgaatatccccgattccgtcgccatttgaatctttaaaactgcgggggtaaatttggtaaacaacggtttccttccaccaagcctttttcatacagccactcctttccagtgtaccggtcttatatatcctatgtagaaaaaaggcttcacagcattgctttttaagaaatgacttgatgacacaaaaaacagccgtttgttccccggctgttttttatcaaaaatcagttttttttatttctacaaaacggatgtggtgatcttcggcgtcgaggattttaaattcacagccctccgcgtgtatcacatcccctgctttcagctccattttttgcgttagaagccagcctgcaatcgtatcaatttcttcattttcaatcgcaatgtcgagaaggtcattcacttcgtctattagcgcttttccatccatcacataatggtgctcgccctttttcaggatgtgcggtgtttcatcctgatcatactcatcgcggatttccccgacgatttcctcgataatatcctctacagtgacaagccccgccgttcccccgtattcatcgacaagaatcgccatgtgaatccgctccttctgcatgcggattaaaagctgctgaacaggaatgctttcaatgaccctgataacgggcctcatgatttgctccagctttatcggctggccgagaaaataagctttaaacatatctttgctgttgatgatccctaaaatatgatccttgtcatctttgatgacagggtagcgtgtataccgttcattaatgatgtgatgaattgcctcttcaagcgactgctccagagagataaccgcaatttctgtccgcggaatcataatctctctcgctacccggttgtcaaattcaaaaatcttatttacataacggaattcagactgattaatttctcccttttcatagctttctgaaaggatcagtcttagttcctcctcgctgatgacaacctgatgctcctttactgaatgaaagccaaacaatttcacaagaaaacttgcagagccgtttaatgctttaataaacgggtacgtgattttataaaaccagatcagcggctttgcaatccataagcttacagcttcagctttttgaatagaaaccgttttcggagcaagctcccccatcaccacatgcaaaaaagtgacgatgataaatgcaactacaaatgtgacaatgtggttaaacggttccggcatgcctgtcattgtaaataagggatgaagaaaacgttcaaatgtaggttcaccaagccatccaaggccgagggcagtaatcgtaatcccgagctggcaggctgataaatactcgtcaagattggagatgattttatgtgcggctagcgctcggctgtcaccgctttcgatgagctgattgatttttgaacctctgattttgacgatcgcaaattccgctgcaacgaaaacagccgtaatgccaatcaaaacaaaaatggcgatcaattgtaaaataagcaaaaaaagcccttaccataaatggtaaggggccacctccttaacgttaattctcatcacgaccgtttaagaaaatcatcacaaaacgaagtagttcaaacagggaaaccagggcggcggccacatacgttaaggcagcagcgctcagcactttatttaccccattttcttcattgtttcggatgaatccttctgacacaataatctgcttggcgcgtgaacttgcattgaattcgacaggcaatgtaatcagctggaaaaagactgccgctgaaaacagtatgatgccaagcccgatcaaattcaggctgccgagaagcatgcctcctaagaaaagcaaaggagctacaccggatgcaaaattcacgactgggaagattttatgtctcagcacaagcgcaccatatgactcctgatgctgcaaggcatgtccgacttcatgggaagctacggatatggcggaaattgagcggccgtaatagaccggctcagataaacgcaccacccgtcttgtcgggtcgtaatggtctgttaaagtgcctcttaccggttcgaccggcacgtcgtaaagaccgtttatatctaaaatccgtcttgccgtttctgcccctgtacgtccgcttgaggcttccacttttgaatatttttcaaagttgctctttactttaaattgtgcccaaaacgacaatcccaatgcggctattgttaaaaatataaacagcattttttcatcatcctttttccatgatcatttctctattaagattattttaatgagttttctttcccgtgtacagaaatgcgctttttcttccggcttggagcacagaatccaatcagcaaaaagaacaggcctgctgaaaacaaataaaaggcgaaaccgccggccagttctttcagaaaataaaaccaggagaagctgccggaaaagtgattatatgaattcaaatcgaaaataaacaaaatcaccgcggatgccgccagctgtgtaccgatcaaaaccacgatcgttctttgaaagatcgtcatctttttcatcctttttgttttagtttatggagaaatccggttttatatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagataagtacggccaggaaaagctaaatgaaaaattaaatacaattattaaacagattttatccatctcagtatctgaagaaggagaaaaagaatgaaatcaaatcggatatttatttcatggctcaggtggccgttatttatccgaatcggggttattattttatgtctgattcttttgttcggccaaatcatttatatacttgagcctaagcagttcacttcggtattcgaaggcatttggtgggctgtcgttacggtttcgacagtcggttatggagactatgtgccgcacacgccgctgggacaggcagccggaatactgctgattttgagcggagcaagctttgtcacagcatatttcgctacgttatcagcggccgcattcagcagacagcatcgctacatcgaaggaaaagttgcttacaaaggccgggaccacatcattctgatcgggtggaatgaaaaaacaaaccggcttttgaaggaccttcagcttgccgccccttccaaaacggtcgtactaatcgatgaatccttaacagaaggcccgcttattgaaaacgttcatttcatacgcgggcacgctgccgatgatgggacactgaaacgggccaatattactgaagcggaatcagtgatgattactgccgatcagtataaaagtgaaactgatgctgatatgctgtcagtgctgactcttttatctgttaaagggcttaatccccttgcttactgcatcgtcgagattttgactgaccgttttgtcaccaatgcggagcgggcaggtgcaaaccaaatcatcggaacttcagaatttatcagccgggcgatgctgcagcattaccaagtcaagttacggccgtctaaacagcagaacggaatcaagctgacacttgatcagcatgtggagcttcttgctgttcctgacgaactaaagggagcggcttacaaaacctgtgttctctatttccttgatcacaacacaacaattataggcgtacaaaaagaggaggggccgatgatttcccctcctcttacatacaaggtgctcgaaacagatcaattccttgccatctagtgtaacagaacatcctccaattctttcacgagagaggcgccgatatccaaaaatgccggatcaatttccgcgtcccgcctttccggttcggaaaattgattaaacagtgattggaaaggccctccctcggcgtgatcgtcaacatccgcctgaaacacctgtctcagcataaacggcgttccgatccggacggccgcccctcgttcatcgagactgccctgtaccgcattgacgggaattcttaaaaataaatagccgtctctatcatcaattttataatcaaagtagccatgatcgtattcccagccgccgtttatcacataaccgagcggcttcatcacttgttccagttcttgaagcagaaaagactgcccatctatcgcggaaggtattggtatcatcagaatgccccttttttcacttatcctgtcccgccgaacaagacttcattcagaggcgcctacatggaaatcgttgtttctttcgcgcggccaacagaaaagaaagcgcattcaattaagaagtaaacagtcattgccgctgcaagccatacagctgaatcccaagacacataaacaaccgttgcatagagtcctaatttagtgaaaagagtatgggttcgttttaaatgcaaaatccgatgtaccgcatcggtaaaaagggcaagcggcaaaccaatgagaagaaaggcgtggatgaaaaaatgtgaaagcgtgccgccaaagcttgaagaaaactctgtatacacggcatcaaaggagataaggaaacttaaaatagctgcagaaaaaccggcaatgatgagatgtttaaccaattgtttcatgaacatcagcacctttctgattttataaaaagccgaccggcaaatgccagtcagctttctcacattaatcttccagacgtttttcaagctctgcttttttctcttcaaagccaggtttgccgagtaacgcaaacatattgactttatacgcttctacaccaggctggtcaaacggattgacgccaaggaggtaaccgctcatcgcgcaggctttttcgaagaaatatacaaggtatccaaaagtatatgcattcagctcaggaatgttaacgattaagttcggaacatttccgtctgtatgggcaagcattgtgccttggaatgctttcttgttaacgaaatcaacagttttaccggctaaatagttcaagccgtcaagatcgttatccgcttcctcaattgtcagttcatgtttaggtttctctacgttcaggaccgtttcgaataaatctctgcggccttcttgtacatactggcctaaagaatgaaggtctgttgaatagttcgctgaagaaggataaatgcccttctcatctttcccttcgctttctccgaacagctgcttccaccattccgcaaagtattgaagcgccggttcgtagttgatgagcatttcaattgttttgcccttattataaaggacattgcgaacaaccgcatattggtatgctgggttatcttccagttcagatgttgcaaaatctttgctcgcatccagggcgcctttcatcatgtcatcaatgttgacgccgctgacagcaatcggcaagaggcctacagctgttaaaactgaataacggccgccgacatcgtcaggaataacaaatgattcgaaaccttcttcgttagaaagcgtttttaatgcgccgcgctctttatcagttgttgcataaatccgcgctttcgcttcttctttaccgtatttctcttcaagaagcttgcggaaaatacggaaagcgattgcaggttcagttgttgtacctgatttagaaatcacattaatagagaagtcaacatcttcaagaagatccatgacgtctctcatataagatgaactgatgttgttcccgataaaaatgacttgcggattgccgcgttttgcttttggcaaagtgttataaaacgcgtgattcagcgcttcaatcgctgcccgcgctccaagataagaaccgccgatgccgacaacaagcaagacatcagagtcagatttgattttttccgcgctttttttgatgcgcgcgaattcttctttatcataatgttcagggaggtccacccagcctagaaaatcgctgcccgcgcctgttttttcatggatattatggtgtgctgtttttacaaagtcccgcaggtatgtaagttcatgttcgttgaagaaagtcaacgcttttgagtagtcaaagcgtacatgcgtcattgcttgtccctccataacggtataatgttttcatctttcactttatatgaacttatctgtgaaatcaagtcaagaagaaagggcggaatgactggattccgccctttgggtttatagagacgcgcgaaggatggcaagcacgtcatctttgttcagtttttggaagttgccgaagcccccgtgttccatttccttggctgcgatatcagcaatcagttcaagcttttcttctccaatattgtaatcagcaagacgagaaggtgcaccgaggcttgtccagaacgcagacagtttatcgattccttcaagcgcaatttctttatctgttttgccttcagtatcaatgtcaaacatgttgagcattaggtttttaaaacggcctacatttgtatcaagcgtgtatctcatccagtttgggaacagtatcgccaaaccgcccgcgtgcggaatatcatatacagctgaaacagcgtgttccattgtatgagaagcccagtcaccaaagtagcccatttggagcgtgccgtttaaagcaatagtaccagcgtacaaaatcgtttcacgaagtttgtagttttccagatcttcaagaagcttaggagctgtttcgatgaccgtctgcaaaacagcaaagcacattctatcctgaagcggcgtgttttcaacattatggaaatattgttcgaatacgtggctcatcatgtcaaccatgccgtatactgtttgattttctggaacggtgaacgtattttcagggtctaaaatagagaaacgcggatgagtgacattgctgccccatacaaatttctcgtttgtttcccagtttgtaatcacggaatctgggttcatttcagaccctgttgcagcaagagttaaaacagtgccaaacggcagcgcatcctccgctgttacttttttgctgaaaatatcccaagcgtcgccatcgtatttgacgccagctgcgattgcctttgtacagtcaatcacactgcctccgccgacagcaagcagaaaatcaatgtcatgctctctgcaaagtcctatgcctttttccactgttgcaagacgcgggttcggctctacacctgacagctcatgaacaacagcgccctcttcttttaaaatgcctgtgacttgatcataaaggccgttgcgtttaatgctgccgcccccgtaaacaagcagtacattcttgccgtattgtttgaattcttttcttaattgatcaagctgaccttttccaaaaatcagctttgtcggattataataagtgaaattttccatagtaaaacctccaaatgatgctggtaaaaaacagattttccattgtaacataagttgacaaaaagaaaaagggaagcagccaaacggctatttcccctttttttatagagatgctttcaaaattgaaagcacatcttctttgttgagtgatttaaattggccgaatgtaccgttagccattgccttgtcagcaattgtgtcaagctgctcatcattaatatcataatcagcaagacggttcggagcgccaaggcttgtccagaatgcggacagcttatcgataccttcaagggcaatttcttcatccgttttacctgcttcttcaacatcaaacacgcgaactgcaagctgtttcatgcgggcagggttttcagacaatgtgtgtctcatccagttcgggaacaaaattgccagtccgccggcatgcggaatatcataaacggctgatactgcatgttcaatattatgagtagcccaatcccctcttgcccccatagaaagcatgccgtttaatgcgattgttcctgtgtacaggatcgtctcacgcaattcgtaattttcgagatcattgatcagcttaggcgctgtttcaatgactgtacgcagaagtgattcacacatgcggtcctgatacggcgtgtttgatacatgatggaagtattgttcgaatacgtggctcatcatgtcaaccatcccgtagatcgtgtggtttttaggtactgtgaatgtattcaccggatcaagaatcgaaaatttagggaatacgagcgggctgccccagccgtatttttcttttgtttcccagtttgtaataacagatcctgagttcatttctgaaccagtcgcagcgagagtcaataccgttccgaatggcaaagcatcttttggctgatgctttttcgtaacgatatcccacgcatcaccatcatactttgctcctgcggcaatcgcttttgtacagtcgattacgcttccgcctccgacagccagcaagaaatcaatgttttgttctttacagatggcaacacctttattaacagtcgacacacgaggattcggttccacacctgctaattcatgcacggtcgctccggctttattcagctgttcaatcacttgatcatacaggccgctgcgtttaatgctgccgcctccgtacacaagcaatacgttttttccgtaaggtttgagttcctccggaagtctttccacttcgccgcgcccgaaaattaatttggtcggattccagtatgtaaagttttgcatgacatctcctccttagattttttattatgcagaatgtcctcaccacatgtaaagcaatcagctctcaccgatcagcataccagatggttttattttgcaagatgctgggaaagaagctgatataagcgagggcaggccagcctcatatggagaatgcatgtatagattctccaatatgtcacaatctataactgttttaataattcatggaggaggttgcaaaacatgagtaccattcaaagaatttgtcttgtattaaccatcattggcgccattaactggggactgatcggatttttccaatttgacttagtagcggctatcttcggcggccaagggtcagctctttcccgaatcatttacggacttgtcggaatcgccggcttaatcaacctcggtctgctatttaagccaaacgaggaaagatcacgtgaagaagcagcaaatcctgaaatgcgataggatatcaatcacgctgaaataggattttgtattaaatcaaaagcaccgaacattcctgtccggtgctttttttcatgcttattttttgataaggtctttgcggttggacatttcgatccactcttcaagcttatcttttaatgtgttgaaaccttgtggtgtagaagcttcttcgcttacttgagcagctttaggttttcttggtttgctttcttttttctcaggcgcagcttgtgtcgcacgaattgaaaggctgattttgcctttttcttcatcaacagcaagtacttttacttgtacttcgtcgccaactgaaaggtgctcgttgatatcttttacgaaaccgtgagtcacttcagaaatgtgtactaaaccttgagtttcttcatctaatgcaacaaacgcaccatacgcttgtaatcctgtaactttaccagtgtaaacactgcccacttcaaattttgctgccattcataacaactcctaagttaaattaaatatctgtttatacgcaatttaaaattatatcacacatgtcttatttccgcaaagaaaactttttcataaaaaaatcaggtttatgcacagcaaaaagggggtaaactgaaaataccaaaggctttctagtattcccccttttattggatgcgaacaaaaggttcgtatctttttttatattgttttgtgcaggaagcgtttcattctgactaacgcttcttgaagctgttcaatcgaggttgcgtatgaacaacggatatatccctcaccgctcggaccaaacacacttccaggaacaacggccactttttcttgcgtcagaagctcctcggcaaactgttctgaactcatccccgtgcttttaattgatggaaaagcatagaaagcgccgcccggatgatgacagctgagaccgatttcattgagcgattctacaaacagattccgtcttcttcgatagctttttttcattttttctacgtcttccatgccgttcttcaggccttcaagggcggcaaactgcgccattgcgggcgcacacatcatcgcatattgatgaattttaagcatggcatcccgaagcaaggatggtgccgcggcaaaaccgagcctccagcccgtcattgcaaatgcttttgaaaagcctgagatgactaccgtccgttccttcattcccggtaatgccgctatacttgtaaattcctcatcatatgtcagctccgcgtagatctcgtcggctaagacgatgacatcatgttttttggcaaactcagcaatctcattcagctcttccttcgaataaaccgaacctgtcggattcgatggtgagcagatgagaatggcctttgttttttcagtgactgccgcttcaaaatcagcagccgttgctttaaatcctttgtctgccgttgtatgaacgtgaaccgggataccgcctgccaaagaaacaagcgcatcatacgccacaaaacacggctcaggaatgatgacttcctcacctggattcacaatggcgcggatcgcaatatccaaagcctgacttgcccccactgtcacaatcagctcattatctggcgagtagctaagatcaaacctgttgctcaaataacggctgatttcctcccgcaatgagtataaacccgcattggccgtgtatgacgtatatccttgttcaagagagagaatgcttgcttcgcggacattccacgcggtaacaaaatcaggctcgccgacgcctaaagaaatgacgccttccatcgttgccgccaaatcaaagaatttgcggatgccggatggttttatttgttgtacatagtctgataaatacgaagtcatttacggtgacaccacgattcttttgtcgtcgtctcctgtttcaaacactttgccgtcatgcttgtattttttcaggataaaatgggttgtcgtagatacaactgaatcaagcgttgagagtttatccgaaacaaaacgcgctacgtcagacatcgaattgccgcgaatcacgacagacaaatcgtatacgcctgacatcaggtaaactgattcaacctcttggaatcggtaaatccgttccgccacttcatcaaaaccgacgccccgcttcggcgttactttgacgtcgatcatggccgtaacgccctcatgtccgtctacttttcgccaatcaatcatagcggaataatcgataataaccttttctttttccagtttgtcaataattgtttttacttcatttacagggatgcccgccatctttgcgattgtttctaaatcggcgcggctgttttcgtctaaaatttctaatatttctgtttctttttctgtcagtttcatttgattcacacctttgcaatgtcaagaaatctcatgacattatatcacgttttttgacgaatgctaagaaaaaacgaggagaaacttccgctagaatttacaatttcagggcataatacaaccatcaaaaaaagggagtgacacagaatggaggcggtttcaccaataaggcggtttacggtcgatggagtcaatgtatactacgaacattatcaaaatcccggcaggcaaacgctggtttgcgtacacggttttttatcatctgcattcagcttcagaaaagtaattcctctccttcgggacaagtacgacatcatcgcgcttgatttgcctcctttcggccaatctgaaaaatcaagaacgtttatctatacctatcaaaaccttgctaagcttgtcattgggattttggagcacttgcaagtgaaacaggctgtgcttgtcgggcattctatgggcgggcagatatcgctgtctgctgctctccaaaaacctgagcttttttcaaaggttgtgctgctttgcagttcagggtatttaaaacgttcacacccgacgatcattttcgggacccatatcccgtattttcatctttatatcaaacgctggctctcgaaagaaggcgtgatgaaaaatttattaaatgtggtgcatgacaaatcgctgattgatgaggagatgattgacggctatggcagaccgtttcaggacgagcagattttcaaagccatgacaaggtttatccgccacagagaaggagatttagaacccgagcaattgaagaaaatgaacaagcctgctctattgatttggggcgaggaggatcgaattgtcccaatggagatcggtaaacggctgcacgcagatttgcctaattccgtgctgtactcacttggccagaccggacatctggtgcctgaagaacggcctgaacttgtttctgaacacattgctgattttatcaattaaaaaaaccggtgctgaaccggtttttttaaggcgtgcaggagctgctgtttttaatgaataaaagctggccagccacttcccggcagctgtcgatcggcagcgtttgttcaaaagaagtttcaaatatttgctgaatgcttttcgccagcacgtcaggatcgtcttcatcatagactgcctgcacgacatcaacagcctccgtttcgtaaaactcttctccatatttaaacgggtcccatttggcaatgatcttaatcatttccctgaccgcttgactttcttccatattcatcaccgcttataataaaatttgcagttctatcttatcatagtgaagcttagaagaataaacatacatgagggggtaacagaatgaactttgataaacgagaagaacgccttggcacccaatcggtcaaatgggacaaaacaggcgaattatttggcgtgacagacgcactcccgatgtgggtggcggatatggattttcgcgcgccagaagcgataactgaagcgttaaaagagcgtcttgaccacggtatttttggttatacaactccagatcaaaaaacgagggatgctgtgtgcggatggatgcaaaacaggcacggctggaaggtgaatccggaaagcatcacattcagccccggcgttgtaacggctttgagcatggcggtacaagcttttacggagccgggcgatcaagtagttgttcagcctccagtttatacgcctttttaccatatggtggagaaaaacggccggcacattttacataatccgctgctagaaaaagacggcgcatatgcaatggattttgaagatttggagacgaagcttagtgacccaagtgttacattgtttattttatgcaatcctcataacccttctgggcgttcatggggccgggaagacttactgaagctaggcgaattgtgccttgagcatggcgtcacagttgtatcggatgaaatccattctgatttaatgctgtacggacacatacacacgccgttcgcttcgctctctgacgatttcgctgatatttctgtgacatgtgctgctccaagcaaaacatttaatatcgccggattgcaggcttcagcaatcattattccggatcgcctgaagcgcgccaagttttccgcaagccttcagcgcaatggtttaggcggactgaacgcgtttgccgtcactgcaatcgaagccgcgtattcaaaagggggaccgtggcttgatggattgatctcttacattgagagaaacatgaacgaagcggaagcctttttgagcaccgagctgccaaaggtcaaaatgatgaagccggatgcatcatacttgatttggctcgacttcagcgcttacggcttgtccgatgcagagcttcagcaaagaatgctaaaaaaaggaaaagttattttagagcccgggacgaaatacgggcctggcggagaaggatttatgcgcctgaacgcaggatgctctcttgcaaccctgcaggacggcctgcgccgcatcaaagccgcattatcgtaaatatagctgttaaacgcctttacgtcttcatttgtaaaggcgttcttaataaaggaattttatattttacttctaatatttagtgttataatagattcatattttatacgaaaggatttcacacgaatggaaattctaaaagactatcttctgcacatctgctttattttgtttcctattcttctttaccaagtgttttggcttggaaaacctgcgattcttgtgccaaaaataaacagcggtttggtcacgctcttcgcctgcggcgcctccgttttatgcattattttcccgattcatgaaatggactacatacaatacggccttcagatgattcccgttatcatttgtttattttacattagtaccgcttccggacttacagtcgccgcatctgtcctatgttttgaactgcttttttacgaaccttccgcaatgtttgttttcactttgctgccttttcttatcattatcccaatcttatttcagaaaaaatggccattcatgtccaaagcgaaaaaactgctgctgtctttattgatcagctgcgtggagattttcctatttttcgcctcaagctggattctttccgccttgaatattttaaattttcaaaaatcaggaattttcgtttacgaggcggcagtctcagggcttttccgctccagtgttcttctattaagcatctatattatcgaaagcatcgccgaaaatatcgccctgcgctcacagcttatccattctgaaaaaatgacgattgtgagtgaactggcagcgagcgtcgctcatgaggtcaggaatccgctgacagttgtccgcgggtttgtccagctgctttttaatgatgaaaccttacaaaacaagtcgagtgcagattacaaaaagcttgtactgtcagagcttgaccgggcgcaaggcattattacaaactatctcgatatggccaaacagcaattatacgaaaaagaggtttttgacctatctgcccttatcaaagagacaagctcccttatggtgtcgtacgccaattacaagtcagtaaccgtcgaggctgaaacagaaccggaccttttgatatacggagacgcaacaaagctgaagcaggctgtcatcaacctgatgaaaaacagtattgaagcggttcctcacggtaaggggatgatccacatatcagccaaaagaaacggccatacgatcatgatcaacatcacagacaatggggtcgggatgacagaccatcaaatgcaaaaactcggcgaaccttattattccttaaaaacgaacggaacgggactcggcctcaccgtaaccttttccattattgaacatcatcacgggaccatttcatttaacagcagcttccaaaaaggcactacggtgaccattaagcttcccgctgatcttcctcactagcaaatcgattggaactttaatagaataaatgcgaggtgatgacagatgagcacgtttgagacaggctctatcgttaaaggattttacaaaacaggtgtatacataggagaaatcacggcttgcaggccgcagcattatttagtgaaagtgaaagcggttcttacccatcccgctcaaggagaccttcatcatccaaaacaggcggatgtgccattttttcatgagagaaaagcgctcgcacatggtgaacagaccaatatcccccaccatatggtgaagccttatgacggtgaagtgccggattataccgaatctctgcgggaggcgacagcacagctgagagccaaattggatgaggatggttcggagtgggcaaaacgctcccttcataatctggacattttagaaaaagaatattttaacctgccataacccagtctgacaaaagattgggttttttacgtcgcgcgcttcaacagttcggttaaatcgattctctcgccgattgtgggcggttttggcttttcgagatactgcttatcctgctcaacaagcttaaaaagtttatatgctgtaagagcatcatcaagcgctttatgatgggtgccggttccggaatctccatactcttcggcagctttccataaacccgtcaatgtccggtctccaaaaaagtttttgtattcaagcgataaatctctcatttctcccttaaacgggaaagggatatggttaaacatacagttttgcttcagcactttcatatccatgtttccccacgtaataattgtgctgtttttctcaggatccagctcgtttagtttacggatgaaatcctcgaatctcattccttcgtctacctgtttttgggttatttttaaaaatgatttgcagcgtttcgtaagcttcgggaactttttcggtctaacatagctagaaaacgtctcaaccacttcatcatcaatcgactttacaattccggcttcaatgatttccgggaagaagttttgaggactgtactttccgtcaggcattgtaaattcgaaatcaataatgagtaagctgtttgtcgtcacctttttacacctgcctttcctccgatcagaaaatgctatctttatagtatatcaattccccttctcgacatttcttcattttctaaaaataatgaattttcccagccgcttcgtttcttttaaattgtgaatcgtttctttataattagtaaggaacccgaaataataagaaggtgatgttatttctatccgtaagaaaaactttgtcattgtgtggctggcgaacttttttgtctccgctagcacaacgatgatcgttccttttctctccttatacattgagacgctcagctctttttcaaacggctttgtgcaaaggtggagcggctatgtgttcggcattacatttctcatggcgttcttggtatccccgttttggggacggttcggagacaaacgcggatataagaaaatccttatggcaaccggaacgggcattgccctcagcattttcttcatgggctttgttacatcggtgtaccaattgttttttctgcgtatggcaatgggtcttgtaaccggattcatcccgacatctcttgcgatgatttcggcacagactccgaagagctcagccggcaaaacactcggcacgctgcaaatggggcaagtgtccggaagcttgttcggcccgcttttgggaggcatgcttgctgatcgtttcggctttacgtataccttttttatcacatcctttgtgattttctcgtctgttcttctcgtgttatttggtgtcaaagaaaagcctcttgcagagaaaacagccaaacgtacgtcttactcgaggaaagaagtgctatcctatatttttcaccagccggcgctgtgggtcatgatgctgttaaccatgctgattcaaacaggcaatttcagtatccagcccctgctcgctttatatgtaaatgagctgcatggacctgtcaatcttgcctttttctccggcatggcattttcagcaacggggctcggaagtttgctgctggctagaaaatggggtgatctgggcgaccgctacggccaccgccgcattttaatcggacttttgctcgccgcctctttcttttttattccgcaggcgctcgcgtcctcactcagcgtgctccttgttttcagatttttattcgggatggcgatgggcggtttgctgccatgcattacggcagcgatccgcgttcaggctcccggcagcattcaaggtgaagttctcggctacaatgtcagctttcgctttttaggaaacgtgctcgggcctctgctcggcggaatcatatcgagccattttaccatttcggccaccttttacgtcacggcgtttctctttttcgccggcgcctgcatgctttggatcatgcagaaacttcggaaagattcttatgccaaagcaagctgattccgagaaaaaactgaggaatcttctaaatttaaccttctcgtaatctcaaaagaatggtacgatatggctagaatttaggagaaaagagagtgaccatgttacgaaaaataatcggatggattttgctcctttgcataatcccattgtttgcatttacagttatcgcttccggaaaagaagtaaaacaaatgaagtccctggatcaggtgcttgataaaaatattaatctgaaagatatcagccttgttcagaacagctacatgtatgacagggacggctcccttgtctcggaaatcgtcagcgaccacgaaaaccgtgtgctcgttccatttaacaagattcccgaggaagtcaaacagattttcttaacatctgaggaccgccatttttacgagcataaaggctttgactttatgggaatggtgcgggctactgcttctaacgtaaaagacaagaaaattgaccagggtgccagcaccatcacacagcagctttcaagaaacttatatttgagccacgaacgctccttcagccgcaagctgacagagctcgcgtattcctatcagctggagaaaaaatatacgaaaaatgaaattcttgaagcttacttaaataccatttattttaacaatggtgtttatggcgtcggttcagcagctcaattctatttcagcaaaccgctgaaatctctcacagtgggagaaatggcttttatctgtgctatacctaataaccctacattatatgatcctctcaagcattttgactacacgaaaagccgtcaagaacgtttgcttaaagggctaaaagatgccggggtcattacggacaaagagctgaaaaaagccgtaaaacaaaaaatcaaactggatgttgaaaaaagagaagacaaatatcctgactacgtttcctacgtcaatgatgaattcactcagctggtgtctgaatcagaaggctttgataaacgccttcaaaaagcatcaggaaaacaaaaagaaaagatcgagaacgagctgtccgcaagagtcagcactctgatgaaagacggcgtgaaaatttatactgcacttgatccgtacatgcaaaatcaagttgtggcacaaatgaattccaagctcccgtatgcggacgtacagggcggagcggctgtgattaatcaccagacgcatcaaatcatcgctctatccggcgggaaaaactatcaaaaatatgactttaaccgcgcctaccaggcgtacaggcagccgggttcatccattaagccgcttcttgattacggcccttatattgaacagaccggcgcgacaacaagcagcaccattgatgccagcaagttttgcagcaaagactactgtccgcaaaactacaataaccgcacttacggcacagtgacgcttgatacggcgtttaaaaattcatataataccccggctattagaatgctcgaccgcgtcggcatccaaaaggcattcagttatattgagccgtatcattttgccaaacttgtcgacagtgactatcttcttccggcggcgcttggcggatttacaaacggcatgacgcctcttgagatgacaaaggcttatacgacattcggaaacagcggaagctatacgccgagccatgcgattacaaaggtgacagaccttaaaggaaaaacactttataaatggaatgataaagcgactcaaatattcagcgtccgcacgaacatgcagctgaaaaaactgatgtcttccgttgtgaaaagcggaacagggaaaaaagcatatttcaatgcgccttacatcggcggtaaaaccggaacatcaaatgattatcacgatatgtggtttgtcggcctgactgatacgtatacaatgggtgtctgggtcggaaaggatacaccgaccagcgttgaatatcttcacagcatcagccctcagctttccatctggaaaggaacgctgcaagcggcttattaaaggatcggaggggatatggagtgacttcagaacaaattccaaatcgcgttttgctgtttgacggtgtctgcaatttatgcaatggagccgtgcagtttatcattaaacgtgatccggacggattgatttctttcacatcgctgcagtcggaaacaggacagagcctgctgaaaaaaagcgggcttccgactgatcggtttgacagctttgtctttattgaagacggccaagtgtacacaaagtcaactgcagccattaaggttttcaggcatctgcgaggcccatggcggctcttcgtcctgtttttcgcagtgccgaagcctgtcagagatatggtctattcttttattgccaacaaccgctataagtggtttggcaaaaaaaatgaatgtatgctcccctccccttctattaaaaaaagatttttaccgtaaataaaaaatggctaggaagctagccaacacagattgttgacaaaatcctaaaacggcttcgttttaggattttgtcatcttttcagcgtgattgaaaacctttgaagtcgacgaagagcgagcattggatgtgaaacggcaggaacctgagaatctagccgccgttttattgcgtacagagcacgaagcgcaaatctgaccactaaacgctgaaatggctagcttacacaggtaagctagccattatgctattataaagcttgataaatatgaacagaataccgataacaaaggtaaaccaaaacagcagttccaatagaatgaatccaactaatgacatgagagaaagcgtcgaataaatccggtacacggtaaacacaaagtaagcgagcgtgacgaccgcaaaccagatcacaatccaaatgacattttgcaagagcacaaaggataaaatcccgccgcccaaataaatcatggaacccattctgagttttttcaggttgttcccttccggatcattagcaaaaaacagcaatgacagctcggtcacggtatttgcaattaatttcagagcggacagaaccataaaatataaaagtgcaaaggcagcaaataacgcaagcctgattcctttctctgaaaaataatcgagcattccatcatacattccaaatgaagacagcatcttcaacgcataaagtgaagttgagatggataaggacgaactaaaaagcaggatcgcaatcagcggaaaatatcctgtcaaataagtatttttcatataaaaaagtccctttctataatctacctcatttattatggaggacttaaaacacattgacaagataaattattccattttttctcctttttacgaattacggtcccaaatcttcacaaagcagcattttgagagtaaagtagtacgcaggaatcataaaacgtaaggaagttttatatgaaaaaaacattaaaactgcaaaccagactcaccatatttgtttgtatcgttgtattaatcgcattgctcattacgttttttacagtcggtgcccaaaccaccaaacgaattagagatcaggaaaaggccactgcgctgcagactgctgaaatggtagctgaggcgccgatgacagccgctgctttagaaagcggaaaaaaacaaaaggaactgcagagctacacaaagcgggttcagaaaattaccggcacggaatttgttgtcgtcatggatatgaacggtatccgcaaaacccatcctgacccgagcaaaatcggaaaaaaattcagaggcggtgatgagtccgaggtattaaaagggcatgtccatatcagcacagcctctggcacgctcgggaaatcgcagagagcgttcgtccctgtctacgcggagaatgggaaacaagtcggtgcagtcgcggtcggcatcaccgtaaatgaaattgatgaagtgatcagccatagcttacggccgctttactttattatttgcgtcagcatcttcgtcggtgtgatcggagccgttatcgtcgcccgtacagtgaaaaatatcatgtacggacttgaaccttatgaaattgcgactctgcttgaagaacggagcgcgatgctggaatcgacgaaggaaggaatactcgctgtcgatgaacatggcaaaattaaacttgccaacgcggaagcaaaacgcctattcgtcaaaatgggcatcaacacaaatcccattgatcaggatgtagatgacatcttgccgaaaagccgcttgaaaaaggtcattgagacaaaaaaacctcttcaagacagagacgtccgcattaacgggctggagcttgtgtttaatgaagttcctatccagctgaaaggacaaactgtcggagcgattgcaacattccgcgacaagaccgaggtaaaacatttagctgaacagctttccggtgttaaaatgtatgcaaacgcactgagagcgcagtctcatgaatttatgaacaaactgcatgttatattaggtctcgtccagctgaaagagtatgatgatcttggagattatattaaagatatagccatacagcaaaaatcagaaacaagtgaaattataaatgatgtcaaaagctccgtactggccggttttctgctcggaaagcaaagctttatacgtgagcagggcgcaaatcttgatattgaatgcaacggtgtcatcccgaacgcggcagacccttctgtcatccatgaacttattacaatcatcggaaatctcatcaacaatggcttagacgccgttgccgatatgccgaaaaaacaaatcaccatgtccatgcgcttccataacagcatacttgatattgaaattaccgatactggagcaggcatgtctgaagaagaccaagccaaagtatttgaacaaggctattcaacaaagggcaaaaaccggggattcggcctttatttcacacagcaaagcatcgaaaatttaaaaggccaaatgatcctcacaagcgaaaagaatgaaggaacgacattcagtattcgcatcccgtacgaaccgaaggaggaaaatcatgattaatgtactaatagttgaagatgaccccatggtgggtgaattaaataaacgatacttaagccaaatagatggctttcagctgaaaggcatcgcttcttcctttcaaagcgctctgcatattttaggcgagcaccatatcgacctcattttgcttgatatttatatgccgggaaaaaacgggctggaactgctgacggaattgagagcccaaaatgaagcggttgacgtgattgtcatctcagcggccagcgagcttgacgtaatcaagaaaacacttcggtacggagctgtcgattatttaatcaaaccgtttgaatttgaacgtttccaaacggctctgtctgattacagacgaaaacaaaaggtgtattcaacccatcgcaacatgagccaaaaagaactggacgccgagctttttcaaaagaaagaagcaacagaaaaagtgcagcttcctaaaggcctgacaaaaagcacgctgaagctgatctggtccagtatccagtcatttgaaaatgaatcttttacgacagaagacttggcaaagcacacagaaatctctcaagtatccatacgaaaatacttaaagtttcttgaagatatacaagttctgaatgtagaaatggcgtacggaacgatcggaagacctgtgtttcagtacaacgtaaacaacagtaaccttaacggaataaagcaatatctataagaaaacgcactgcttgctttgagcagtgcgtttttctgtcatatctcttgccaagatgcttgattctattgttgataagttatacaagaataacaaagggctttcacatttttaagcaaataattctaaaaatagatactttttaaaaaattatgcgaaattctatttatttcttattagttaaatgataaattatgattggttagttgatcccgaaaaactaagtcataagtcttacttcagaaaacgatgtcacggttttccgcccggaacgccttccgcatccttctcttccccgcctttcgaaggaaatactcacaccacgcttattcagggaagaatagaactgtctcagcgcattccatttgttattatcagaaaattttatcgattctaagaaattgttcaggacagcccatcacatgactggccggatcagctttgaaccaaatttttctggggggttatatcttgaataaacgaaaaatcggattggcgatgtcacttgtgatcgcagcaggcaccatattaggagcatgcggaaacagcgaaaaaagcagcggctcaggcgaaggcaaaaacaaattcagtgtggcgatggttactgacgtaggcggagtggatgacaaatccttcaaccaatcagcctgggaaggcatccaagcctttgggaaagagaatgggctgaaaaaaggcaaaaacggttacgactatcttcaatccaaatcagatgcagactatacaacgaacttaaataaattggcgcgtgagaattttgacttaatttacggcgtcggctacttaatggaggattcaatcagcgaaattgctgaccagcgcaaaaatacaaactttgcgattatagatgctgttgtcgataaagacaacgtcgcaagtattacgtttaaagagcaggaaggctcatttctcgtcggagtggccgcagccctatcaagcaaatcaggaaaaatcggctttgtaggcggcatggaatcagagttaatcaaaaaattcgaggtcggcttccgtgccggcgtacaagcagttaaccctaaagccgttgtagaagtgaaatacgcaggggggttcgataaagccgatgtcggcaaagcaaccgccgaaagcatgtataaatcaggcgtagatgttatttatcactctgcgggcgccactggcacaggcgtctttactgaagcgaaaaacctgaaaaaagaagatccaaaacgcgatgtctgggtcatcggtgtcgataaagaccaatacgcagaaggccaggtagaaggaacagatgataacgtcaccctcacttccatggtgaaaaaagtagatacagtcgttgaagatgtaacgaaaaaagcgagtgacggaaagttcccgggcggcgaaacacttacctacgggcttgatcaagacggagtcggcatttctccatctaaacaaaatctatcggatgatgtgatcaaagcggtcgataaatggaagaaaaaaatcatcgacggattggaaatcccggcaactgagaaagagctgaaaaccttcaaagctgaataagaatcgcagggataaggaggtcgagcccttatcccttgtttttcttttattttgaaataaaggagcggtcaatcaatggaatatgtcattgaaatgctcaatatccgcaaggcgtttccaggtatcgtcgccaatgacaatatcaatcttcaagtcaaaaaaggcgaaatacacgcgttgctcggtgaaaacggagcggggaaatcaacgttgatgaatgtccttttcgggctgtatcagccggagcggggtgaaattcgggtgcgcggcgagaaggtgcacatcaacagcccgaacaaagcgaatgaacttggaattggaatggtgcaccagcactttatgcttgttgacacctttacagttgctgaaaatattattctcgggaaggagccaaagaagtttggcagaattgaccggaagcgtgctggccaagaggtgcaggacatttccgatcgatacggcctgcagatccatcctgaagcaaaagcagctgacatatcagtcggtatgcagcagcgcgcagaaatattaaaaaccctctaccgcggtgccgacattctgatttttgatgaaccgacggctgttttgacgcctcatgaaattaaggaactgatgcaaattatgaagaacctggtcaaagaagggaagtccatcatcttaatcacccataagctgaaagagattatggagatttgtgaccgcgttacggttatccgtaaaggaaaaggcatcaaaacccttgatgtccgtgatacaaaccaagacgaactcgccagtctaatggtcggccgcgaggtatcgttcaaaactgaaaagagagctgctcagccgggagcggaagtgcttgcgattgacggcataactgtaaaggatacccgcggaatagagacagtcagagatttgtctctttctgtcaaagcgggagaaatagtcggcatagcaggcgtcgacggaaacgggcaatcagagctgatcgaagcggtgacaggactccgcaaaacagattcaggaacaatcaccttaaacggaaaacagatccaaaacctgacgccaagaaaaatcactgaatccgggatcgggcatattcctcaggatcgccataaacacggtctcgtccttgattttccaatcggagagaatatcctgctgcaaagctattacaaaaagccgtattcagcattgggcgttttacataaaggcgaaatgtacaaaaaagcacgcagcctgatcagcgagtacgacgtcagaacgccggatgaatatacacacgctcgggcattgtcaggcggaaaccagcaaaaagcgattatcgggcgggaagtagaccgaaatcctgatttattaattgccgcccagccgactcgcggccttgatgtcggagcgattgaatttgtccataaaaagctcattgagcagcgtgatgccgggaaagccgttcttctcctctcgtttgagcttgaagaaattatgaatctcagtgacagaatcgccgttatttttgaaggacgcattatcgccagcgttaatccgcaggaaaccactgaacaggagcttggtctcttgatggcaggaagcacgcaaaaggaagcggggaaagcaaatggttaaacgactctctcatttactcgtgccgctcatcgcaatcatccttggtcttgcggccggcgcgttgattatgcttgtgagcggctacagtgtggctagcggatattcggctttgtggaatgggatattcggagaaatctattatgtcggagaaacaatccggcaaattacgccttatattttatccggattggctgtcgcctttgcattccgaaccggactctttaatatcggcgtcgagggacagctgctcgtcggctggacagcagcggtttgggtcggtacggcgtttgacggaccggcatatattcacttgccgctcgcattgattacagcggcagctgcaggaggattatgggggtttattcccggcattttgaaagcgcgattttacgttcatgaagtcattgtcaccattatgatgaattatatcgcgctgcacatgaccaattacatcatttcaaacgtcttgacagatcatcaggacaagacggggaaaattcacgaatccgcctccctccgctctccttttcttgaacagatcaccgattactcacggctgcatttgggaatcatcgttgcccttctcgcagcagttatcatgtggtttatcatcaacaaaactacaaaaggatttgagctccgggcggtcgggtttaaccagcacgcttcccagtatgccggcatgagcgtgcggaagaatatcatgacctccatgcttatctccggcgcttttgcaggccttgccggagccatggagggcctagggacattcgaatacgcagcagtgaaaggcgcatttaccggcgtaggctttgacggtatcgctgtcgctcttctcgggggaaacacagccgtaggcgttgtactggcagcatgcctgcttggcgggctgaaaatcggcgcattaaatatgccgattgaatcaggcgttccatcagaggtcgttgatattgtgattgctattattattctatttgtggcttcaagctatgcgattcgtttcgtcatgggcaaattgaagaaaaagggggcgaactaagtggacattgtgcagattttatctatcattgtccctgccacactcgtctatgcggccccgcttattttaactgctctcggcggcgtgttttccgagagatcaggtgtggtgaatatcggcttagaaggcctcatgattatcggggcgttcaccagcgtgttatttaatttattttttggtccggaattaggtgccgccgcaccttggctttcgctccttgccgccatggcagcaggcgccctgttttcactgattcacgcggcagcggcgatttcgtttcgcgccgaccagacagtcagcggtgtcgccattaacatgctggcgcttggggcaactttatttatcgtcaaactgatctacggcaaagcgcagacagacaaaattccagagcctttttataagacgaaaatccccggtttgggcgatattcccgtcttgggaaaaatcttcttttcggatgtctattatacgtctattcttgcaatagcacttgcctttatttcctggtttatcttattcaaaacgccgttcggccttcgtatccgttctgtcggcgagcatccgatggcggccgatacgatgggaatcaacgtatataaaatgcgctacatcggcgtgatgatcagcggattgttcggcggtctcggcggcggcgtatatgcctccacaattgcgcttgatttcacgcactctaccatctccgggcaaggttttatcgccctggcagcgcttgtattcggaaaatggcatccaatcggagcactgggggccgccctgtttttcggattcgcccaaagcttaagcatcattggatcactgctccctctttttaaagacataccaaatgtgtatatgctgatggctccttatgtcttaacgattctcgctttaaccggctttatcgggcgggcagatgcgccaaaagccaatggcgtgccttatattaaaggaaaaagataaaacattctcccctgggaagacgattctcaggggtttttttctaatccaaaagacccccttaatttaattgtttattagttttttaacttaaaaaaatatgaagtgttaacgctttcttgtagactgtaacaaacaatacatgggggtgtatgacatgggagcaattccaaaaacggggacaatttcacctgagcaaaaagactcacaggggaaaaacctgtttcaaaaaatctggtcttgggaaatcggtgtgattcctctgcctttatacacagtattagctgttattattattcttgcagcctattacaatgagctgccggcaaatatgcttggcgggtttgccatcattatgattcttggtgtgtttctcggagacataggccaacgcataccgatattgaaggatattggcggccctgctattttatctttgtttgttccttcatttttagtcttttacaatgtactgaattcaacatctttagacgctgtaaccaacttgatgaaaacgtctaacttcctttatttctatatcgcttgccttgttgtgggaagtatcctcggtatgaacagaattgttttaatacaggggtttatcagaatgttcgttccactggttgcaggaacgatcgcggccgttgcagccggcatccttgtcggatttatttttggctatagtgcctatgattcctttttctttgttgttgtcccgattattgccgggggaataggcgaaggaattttgccgctttcaatcgcctactcacaaatactgggctcatctgctgatgtatttgtgtctcagctggttccagccgcaattataggaaacgtttttgctatcatatgtgcagccttaatgaaaaagcttggcgataagcgtccagatctaaatgggaacggacgtctcgtaaaatctaaaaaagcaaatgagattttcaatcaaaaagaagccgaagcaaaaattgattttaaactaatgggagcgggagttctgctcgcgtgtacattctttatttttggcgggttattggagaaattcatcttcatcccgggcgcgatcttaatgattatttcagctgcggctgtcaagtatgcaaatattcttccgaaaaaaatggaagaaggcgcttaccagctttataagtttatttcttcaagctttacatggccgctgatggtcggtctcggcatcctctttattccgttggatgacgtagcgtctgtgatttctataccgtttgtcatcatctgtatttcagttgttatcgcgatgattggttctggatatttcgtaggcaagctgatgaacatgtatccggttgaatccgcaatcgttacctgctgccacagcggtctcggcggaacgggtgatgttgccattttatcggcatcaggaagaatgggccttatgccgtttgcccaaatttcaacccgtctcggcggtgcaggcacagttatttgcgcgacagtgctgcttcgttttttcacttcataaacagaaagagttccgttttatgcggaactctttttttatttattcacaatccgaatatactctcggggaccaaacggcagatcctttgattccatctcactcattctggctgacaggtggtgctccagtaaatacagctcccactcatcactagccgccacaccgctgcgcccgtcatattgattcaacatgaatgcccctgcaaatactgagcagaataaacctgagcacatcacgacttttcttttcacatgaccagctcctttccttcagcttgatcaggattgattttaaatatacaaataacctcttttttgttagacttattttgaggtcaaaagaactcataaaaacccattacagcagttcgaagcgtggcagcttgcagaaaagtgcgatataatttggactaggtcgtttgaccgtatatttcatacatagcgcatttttcaattgagaacgagaaaaggaggtcttatctttgcagctcttacatcttgctattttatcgccttttttatttgcttttatcattcccttcttggcaaaatacgcaaaaagagtgcatacgggctggtttgtgttgatcctgcccgtcttgctgtttatatactttctcccaatgatcaggatgacacaatctggagaaacacttcgatcggtattagagtggattccgtcactcggcattaactttaccgtttatatagacggcctcgggttattattcgctttactgatcacaggcattggctctttggtcactctttacagcattttttatttatcgaaagaaaaagaacagcttgggcccttttatgtctacttattgatgttcatgggcgccatgctcggtgtcgttctagtagacaatgtcatggttctctacatgttctgggagcttacaagcctttcatcctttttgctgatcggctattggtataagcgagaaaagtcgcgctatggcgcagccaaatcacttttgattacggtcagcggcgggctgtgcatgctcggcggatttattctcctttatttgataacggattccttcagtattagagagatggttcaccaggttcaattaattgccggccacgaattgtttatcccggctatgattctcattttattaggggcttttacgaaatcagcgcaatttcctttttacatctggctccctgacgcgatggaagctccgacgcctgtcagcgcttatctccattcagctactatggtaaaagccggcatttatgtgattgcgagattcagccctattttcgccttttcagctcagtggttttggatcgtgtccctcgttggcctctttacgatggtttggggttcattccatgccgtgaaacaaactgatttaaaatcgattttggcgttttcaaccgtcagccagctcggcatgatcatctccatgctcggagtcagtgctgcggcccttcattacggacatacagaatattatacagttgccgctatggctgccattttccatttgatcaaccacgcaacctttaaaggaagcttgtttatggcagtcgggattatcgatcacgaaacaggcacacgggatatccggaagctaggcggcctgatggcgattatgccgattacatttaccatttccttaatcgggacattttcaatggccggcttaccgccgtttaacggatttttgagtaaagaaatgtttttcacaagcatgcttcgcgtgacacattttgacctgttcaccgtgcagacatggggcgttctgttccctcttttcgcctggatcggaagtgtatttacgtttatctacagcatgaaattgctgtttaaaacattcagaggaaattaccagcctgagcagcttgaaaaaccggctcacgaggcgcctgtcggcatgctcgtaccaccggtcattcttgtcgctttggctgtcagtctcttctttttcccgaatatattgtcgtacagcctgatagagcctgcgatgaactcaatctatccgacactgcttgccggccatgagaaattccacgttcacatttcacagtggcatggggttacaacggaattgctcatgactgcgggtattgttgtgatcggaacaattggttatttgtcgctgaataagtggaaaggaatctataaactgtttccttcgaaactcacactcaatcggttatacgataagcttttgactctgatggagaaaggctcttaccgggtcacaaaacaatatatgaccgggtttttaagagattatttgctgtatatcttcgctggtttcatcattctgataggcggagcttttgccattaaaggcggattttcatttaaaacggaaggcatggctaaaatcggtgtatacgaaatcattttgacgcttgtcatgatcagcgccacagtggcgactgtttttgctaggtcaagactgacggcgatcattgcactcggtgttgtcggttatacgcttgcattgttttttgtcattttcagagcgccggatttggcattgacccagctcgtcattgaaacgatttctgtggcactgtttctgctttgcttctaccatttgccgaaactgaggctgaaaacaaaaacgagaacgttccggatgacgaattttatcatttctttaggcgtcggtattattgttactctgcttggtatcgcatcctcaagccagcggacaaaagacagcattgcgtccttctttgtcaaacacagccacgatctcggcggaggggataatgtcgtcaatgtcattcttgttgatttcaggggatttgatacaatgtttgaaatcacggtattaacgatagccgctctcggcatttacagcatgattaaaacaaaagtaaaagaggaggggaaaagcggtgaatgaacaaaaaacaaatgacttgattcttcaaaccgcgacaaaacttgtatcctttatcattttgcttttctctttctatttatttttatcagggcataacgcgcccggaggaggctttgtcggcggactgatcacgtcctcttccatcgttctcttgctcttggcgtatgatttaaaaaccgtgcgttcccttttgccggtcaatttcatttatgtcgcgggagccggccttctgctcgctgtattaacaggcgttggctcctttgtcttcggagctccttttttaacccacacattcggatactttcagctgccgatccttgggaaaacggagctcgccacagcgacgatatttgatttaggcgtttatcttgttgtcgtaggcataacgatgaccattattcaaacgattggagaggaagaataatggaaatcttaatggctgtattagccggtattatttttatggctgctacgtatttgctgctgtctaaaagcctgcttcgcgtcattatcggaacagcactgttaagccatggcgttcatttaatgcttttgactatgggaggattaaagaaaggcgccgctccgattttgagcgagcatgccaaatcatttgtcgatccgcttccgcaagccctgattttgaccgcaattgtcatttcttttggcgttacatcattcatcctcgttatggcctttcgcgcttatcaggaattgaaatcggacgatatggatcaaatgaggggaaatgatcaacatgaataattttgttattttgccaatcctgatcccgcttttgtcggctattcttctgattttcatgacgaagaatcttatgctcatgagaatcttcagcacggcggcatcggccatcgggattgtgattagcggcatacttgtacagactgtcttcacaaaaggcatccagacactcagcttaggcggctggaaagcgccgtacggcattgtgcttgccgcagaccaattcgccagccttctcgttctcacaacagcgatcatcggtttattggttgggctttattccttccgttctgtcggtgaaaaacgggagcgctccttttactactccggcgttcagttcttgcttgccggcgtcagcggagcgtttttaacaggcgatttatttaatatgtacgtattttttgagcttctgcttattgcttcctatatgctgattgtattaggcggtacaaaaattcagctgcgggaatcccttaaatatattgtgtttaatatcgtatcgtctgccctgtttgtcataggggtcggctttttatacgctgtaaccggtacgttaaacatggcagatcttagcatgaaaatcagcgaaacaggacaaaccgggctgatcactgtgattggtgtcctgatgcttttggtatttggcatgaagggcggaatcttccccctctacttttggcttccaggctcttattacgcgccaccggcagcaatctccgcgttgttcggcgctttgctgacaaaagtcgggttatatgcgattgcgagggttttcacattgatttttattcacgatacagcctttacccatcagctgatgatttggctggcggcgctgactgtgatttttggtatcatcggttcactcgcttattcgaatgtcatgaaaattgtgatctataacattattaccgctgtcggcgtgattttgttcggtgtggcagtacacaccccagcatccattcagggcgcgatctactatctgattcacgatatgctgattaaaggcgctttgtttatgctggcgggtacgctgatcgcattgactggaactgcgagcctgcataaaatgggcgggctgatcaaacgctatcctgttcttggatggatgtttttcatttccgctatttctcttgcaggcattccgccactgagcggatttgtcggcaaatttaaaattgcggagggcggcttcgcagaaggtgaatttacgatatccatgctgattctgctttcgagtctgcttgtactgtactctgtgctgaggatctttatacatgcgttttggggcgaagaaaaagaaacgccaaaaccaaatcatcgaacagctaaaggacttctttatccggcagctatttttctcttgctgtctcttctcttcgggttgggtacagaatgggtgtcgccttacgttgatcaagcggccgagacgctgctgaatccggaaaaatatatcgaagctgttctgaaggagtagatcgcatggcttttcaaattttattaaatgtgtttctcgctttttgctggatgttcttaagcaacagtccaagcgccgcaggattcattacaggctatattctgggaatgctctctctctttttcttccggcgctttttcactcgccagttttatctatggaaattgatttctatcatcaagctctgtttcatttttataaaggaactgtaccttgccaatgtcagtgtgatgaaatcagtcttatctccaaaactgaatatcagaccgggtatttttgcttttaaaactgaactgacgaaggactgggaaatcaccctgctttctctgctcattacattaacgccgggaaccttggtgatggatatttcagatgacagaacaatactttatattcatgcaatggatatcgaggatgcggaaaaagcgatttttgacattcgggagtcatttgaaaaagccatacaggaggtgagccggtgatgtttacgctgatcctgcaaatcgcgctcggcattatggcagtgtctacctttttgtatgtcattcgtgtcattaaagggccgactgtgcctgaccgggtcgtggctctggatgcaatcggcatcaatctgatcgcaatcacggcgcttgtctccattttgctgaaaacaagtgcgtttttagatattattttgctgctggggattttatcgtttatcggaacgatcgcattttccaagttcctggagaaaggagagattatcgaaaatgatcgaaaccgctaaggtcgttgtggctgtattcattttgctgggtgctcttatatgcctcattgcttcatttggcgtacttcgccttcccgatgtgtttacacgcgctcatgctgcttctaaaggctcaacattgggtgtcaatatgattctgctcggtgtcttcttctatttgtggtttgtgacgggggagctctccgctaaaatcctgcttgggattctctttatctttattacgtcgcctatcggcgggcacttgatctgccgtgctgcgtataactccggcgtcaagcttgatgagagaagcgtacaggatgactataacggaatcagaaactttgtgattaaacgaaaagaggattcttatctataaaaataagcagccggacaggcagagttccggctgtttttttatttcttgatgacagccagcgtgcatctggatatacagatcagcctctcttgctcgtcatatatgtgaatgtgatagacaatcgtcgttctgccgatatgaacgggctcggctaccgcctttaccgttccttccttgacagattttaaatggttggcgttaatctccaaaccgacacaagcctgtgttgaatgatcaatcaggttctgtgcacctgcgctcgccgctgtttccgccagggccactgaagcgcccccatgcaaatatccgaacggctgcaccgtccgatgatccaccggcatgaccgcaacgcaacgttccgctgtgttttcaacaatctctataccaagcgcttcaagcaatgtgtgcttcgtatccatcatctacacccccaatatttaaagtacaccgtctgatttcgcaatcaaaaccgcttccgtccgggaaccgacattcagcttattaaaaatcgatgtcaagctgtattcaatggaccgcttgcttaaatgaagggcatctgcgatttcttggtttgtaaatcctttttcaacttcttgaagaatcaggcattctctaggtgtgagcacatcttgttctttttgagaggaaggagccggctttgttttttgctgagtcatcagctgtttaaagtaagcaaaatcgactaaaatttctccattgagtacgtggtatatgtattgggtgatcttttctttagattccgttttgctgatggcaccgtgcagacccgcacgaatcgcttcctcgaaataatcctcgacctcataaccggtatacacgataattttacaatgaggattctcttgtaaaatctgtttagaaagctccatcccattgacctcgccgcctagattcagatccattaaaatgagatcatatgacgagaaatcatgctgcttgataaactgttcgctcggttcaggactgagacaatcaacagacaaattcgaatccgtttccaaaattgtcttggtgccttccatgacagccggatggtcatcaatcactagtatctttttcatgttttcctcccttttactcactcttttccattttataaaaaagacttggcctgtgccaagtcgtttccgttataaatccattacaattcgatttcaatatcagccttaaagccctttccttcacttgtttcaatccgaaggcgcccatctaaagccctgactctctccttaatgccagaaagccccatgctcatggaatgctcagtatttttttcttgatcaaaccctacgccatcatcctcataatgaagaacgattttgttttgaatactgatgagcataatcagcacatccgtcgcctgagagtgcttgaccgcattagacagaaactcttgaatgatccggtacaaattcagctgcgaatccagatcaagggaagccgtaaatctcccggtatttaaacggatatgaaacggaacccgctcctgctgctgcgccaccagcttcgacagcgccttcaccaatccaagatcatacagaagctgcggccgcagctcatgacacgtctccctcgtcatcgaaatcacatcagacatctgctcattcatctgcacaagcttgtcctgcacctcttcacggcacggattatcatccttcttaaaatcacccaaaaacagctcacactggcgttttaaggaaattaaatcctgaagaaccgaatcgtggagatcgcgggcgagatccgagcgttgtttttcctcgatcgtgtacatgagttttttgagccatacggggttggattcttgttgttttatttcttctaaatgactcatcagttcttcgattttcatgacgttttcgatcgatacgtttgtataaaaagccaaagttttcagccaagaaagttcttcgagtgtgagacgaggcgtattcattttagataaacaaaggatcacaaatgatttaccaccgcgttcacctattttcatgacaaagcctttattaaattcaacgattttccctatttcggatgttacttttctaaattctttttgatagactttttcaaatgaatttacgttctcatcatcatatagtttaatatttccgtcagctgaaacttcatatacatgtgctcggctaacaagagaaacctcaagtatagtatttttcagttcttcaaatacttgagatagggaagtagagtctcttatcatctgcgtgaatttatatatactgtcttgataattgaatttttctgagaccctttttaatctaaatctgaaatcaagtacttctttataataaaagaccgccaacatgataatataaattaaaaaggttagtttaacactataaaaatcactatcaggactactaattaattcaattgtagagattagaataattgttggcgttagagctaaaaagccatagtaccttaatctgcttaaaataaaatctacattatagattttatttgtcatgaattgaaataccaatgagaatggtatcagcagcataaatgaagccgctaaaaaagaagaaacataatgtgcatttaaaaacacgtaaggtatcaaatataaacacagaaaaggcgaaaaagaaaagatattaatgatagtgagaaccttaataatatgtgcttgttcagtgtctttatttttaattagtatgatactaaaataaacccctactataataaataaaaagaaaaaagcaagtaaatttaatttaggaacataatctcgaaagaaaagatgtgaacgaaaaatttcacaaactacatttatgaccggaatcaaatataaaataaaaactttcttattaaataatttggttcctaattctttgaaatattgataaagaaagagaagatagtttagcggaacagatattaatgttaccaccattataagcctgctcagcatatctcccttagcagaccctccagcacttataaatgcaatagaggcagacaacagaaagataattaaaactacagctgagagaaggttctttgattcatttatttttaatataaaaaagcaacaaaataaacaaacaatataaaatattaacggtattaagtaagtagtgaaatttttatcattaaataaggtcattttcaactcaagattatgtccatttctttccacaatcatcgaacttacattttttagtttgttcatttttatttcgtttgtgtttatctttttattattaatactctttacgatatctcctttttctataccgctgtatgaagccattgaaaattcatctacattggtaattacaatatcgccattttttcctttagagacagttgcccctactaataaattattattactaatataagtcaaataaataacataaatcaaacttaatacaactaacactacagaaattttgttatttctagacttcatttaaacctcagtacttccaatctagcattgaataaatttctaatcctttaaaaccatttattatgcattcagattgatcattatcaacacccaataaacaagcatttccttccattacttcccttaaaacatttgggtatttaattaagtatcctaccatttcttgcataataaatcccctccttatttaatcataacagacaataatttttcagttttatcttctcctagttttaattgtgacatttcattttttattttttggagagataaatgtttcatcaccagtaaatattgtataacgcctgcttctgtcaattttcgcttcaaagccttagtattaattgaaacaaattcctctggtttttgatataaacttagtagctccgctgaagcatcgttaaattgtttctttaagtataagtatgccaatgtattttttttctgaacaaaatcgttatttaagtaaaacaaacctttataatcattatcgatctgtgaaataatcccaagttcataagaataagaagccacgatgggatgatatttgcctgttgccaacattactcccattacacaaggcaatgccgttagcgctcctgatttatttttgatcatttcaagacaggcttcttcagtttgcggcgcattcacaatatcatcatgctggccttgaattgattgtaacgcaaaattcaatatctcttgtgaaaattctggttcatgactagcttgacacatcacttgtatacttagggtgtaaagagctgtaactgcatttaaagcgattgacgagtcaatcttcatccagacagcacttccattatcttgatcctctaagtcatcataaatatcgaatgagagtataagcaattcaattccggcagctagccattcgattgctttttggtcctgaccgttaaaagctaaataatgatgaagagccaaatcggcaaactcaaacgtatccttagactcaataaaattctgaagatatcgttccaagtcctgattcattattttttggcttacaatctccttcattttctccttgatccggacagaatctaaacatatctgctcaataacgacttcccccctcccattccattttactaaatgggacatttaaaggacagcaggtttttcgttttttaacaatcatataatactttatccatttattgtatcggtagaacgaaaaaaaagacttgtttccaagtctttttcacgaaattttcattgcataattgtatttatcgagttgatcaatgcttttgttaatgtttcgtaatgaatctgtcgtttctttaatatcaagttcgagtcggaataacaattgttttacttcttcaagtttcttttccatcgtttccacactcctttttttgaaagatcaatgaattgtgtatggtgaacgagtcctaggtatttgatctgttactaatagtgtatctgctttcggctcatttttcaccgaaaagtatgcaaaaaagtcctgcgtgacaccgcaaatctcaataggtccttatactcaaaggaatcacaacaagaacgggactatctttctatgcgaaagagcgtttatatgtgctgaaattgagaaagattcttaatctccttgattttaacgggtttcgcattttcattaagcaagactatagtccttcataccgtattttcaaaattgaatatgcgattcttggcgtttcctgaccgacaaacaccgaaaaagaccgcaacgctaaagttgtggccttttcgctttgtcatattcggcaattagggatctatacatatagaaacatccttttttgcgaggtgctcccatgagatatcgttatccctggttttacgtgtatccgtatgaggtacgccgtccgcccgctcctgccaacaatattgatacctttatccgttcagcgaggcaggccgcagggatatttgcggatgcccagctcgttctcggccgcattgcgggctcgcgggagctctcgcgccgcattctgacggcagccgagcagtccgataaacaaaccatcaagcgcctgatcaaacaattgggcgtccggcatgaagtggatacggtctttaatcccgacggcatctatatcagtcttatcggaacgcaaagccgaatgattcttgctttgcggtggtcagaggaccgcaatcattttgcgtccataagattatgacaccattccagagcctcaagataacattcatacgcttcttctttgtcgagttgattgcctaattccgagcaagtgtcccagttgttgctttcaattaatttcacaagctcaagcatttggtagtagtcgttttgatggcctaataatgcttgcccgacttcatcttttaaaggcaattcttgaacaatttcctctatttctctatgcaggagggtgtctatgagagaaaacattccgatcagcatataagaagcaggctgcggccgggatgtctttctcgccagcagttcgcaaagctttgctcttatcaaagaaatcttaatgatttcgtgcttgctggaatgccctttcctgcttaaatccttaaaggaaagaatatagatccaccgtttgatttcattaaatcccagcagcataatggcctgttgaatgctttcaattttctggctcaaacggctgtgggatgagtttaaaaattttaaaatttgataggacagtgataaatcccgctctatgtactctgtcacacgctttatgttaggctgctctttactcagttcgttaagcagttcatagtaagaatagaaatgagtcgataggtcatgcccgctgatgatgcgcggctcgctgaaaaagtagccttggaataattgaaagccgtcttggaccgcctgtttatattcttttcgggtctctactttttccgctaaaaaaatcaggccgcggcagccgtaggtttgcaaaattgttctgcgttccattcgtgttgttttgagaaaatcaattttcaatatatcaatatagctcatgagtttttccagtaagtcctcatcttgcgggtttattgcataaaaatcatcaagcgccagcatataccccatttttttcaattctttgcatctagaaatgagggccggcgtgatcggtatatcttcaaggatttcaatgacaagctgtttcggattgaaggaggtaggaagattcgaaaacatcaggctttccgtaaaattaacaaaacagcgtttcccttccgtcagcttctcaattccgatgtttaaaaagctgttgatcaccaaatctgttgttgcctgatcgccgtctttagcgctatacacgttctcttcgctttctctatacagcagttcataagcaacaacctgttcttttctattaaaaataggctgtcttgcaacaaacaccctcattgatttatcccccttacaatacgcgcggctttcacccctaagtatatcaaataatttgacgaaaattgtctaaacatgaaaaataatatatacataaagaaaactggcccttcgtgaacgaaaggccagtttttctttattcttcctcaagctcttcttcaattctgcttttcacttcgtggatccgctgcattttattgctccagcagtcctcgcttaaatcaaccgggtattcctccggcttgctgattctcttatattcctcccaaagcaggctgaggttatcctgcacatactgctgtatgtctgaaatctcagggttttggtagcaaagaatacccttctcaaaaatcagctcatgaagatccttcgcataaaaattcgtgacaaatttgctgatgaatgtatgaaccgggtggaacattctgagccgcttctgatcattcacctgctcatcataaagcgcaatatagtcgccttcagaatgatggttggactgattaataatgcggtagactttctttctgcccggtgtcgtcactttttcaggattggacgaaattttgatcgtgtcaaccattttcccgtcttcttcaatggcaacgagtttataaactgcgccgagagccggctggtcataggcagtgatcagcttcgtaccgacaccccagacatcaatgcgcgctccctgagcctttaaattcataatggtgtgctcatccaaatcgcttgaagcaatcaccttcgcatctgtaaatcctgcttcatcaagcattttccgggctttttttgacaggtacgccaaatcgccgctgtccagacggatgccaatgaaattaatgcggtcgccgaattccttggcaaccctaatcgcgttcggcatgcctgaacgaagcgtgtcatacgtgtcaactaagaaaacgcaatccttatgtgtttccgcgtattttttgaaagctgtatattcatcgcggtaagcctgcacaagcgcatgcgcatgtgtgccggaaaccgggatattaaagcgctttccggctcttacattgcttgtcgcgctaaagccgccgattaaggctgctctcgctccccacatggccgcatccatttcgtgcgcccgtcttgttccgaattcaagtgcaacttcatcaccaatgacgcctttaatccgggcagcctttgttgcgattaatgtttgatagttcacaatgttgagcaaagctgtttcaatcagctgcgcttctaccaggggtgcctccaccctcataatcggctcattgttaaaaacgagctctccttctttcatggagtaaagtgaacctgtaaaagataagccgcgcaaatattcaataaaatcttcatgatacccgagttcatcctgtaaataactcaaatcgctatccgtaaacttgaaattttccaagtattcaatggctttttccaagcccgcaaatacggcatagccattttcaaacggaagccttctgaaaaacagctcaaaaatcgctttcttttcatgaatgccgtctctccagtacgtttccgccatattgatctgataaaggtctgtatgtaatgacaggctgtcatctttaaatccgtactctaacactgtttttccccttccttactctgccacttgcgctccgatgctgtttgcaaaatgggaaagagcccatgcgtgcccctcctgattaaagctggcaacagcttgtttatgcacaacaatcccaaaacctttgttgtatgcgtcaacagctgtatgcaacacacaaatatctgtgcagacaccggcaaggtgcagttcgccaatctgccgctctctgagtttgagctctaaatcagttcccgcaaaagcagaatatctcgttttttccatgtagtaaacattaggctcatgttcatgtttctgatatagaggcaaaagctttccgtacagatcttttccttccgtgccttttatattatgcggaggaaaaagacgggtttcagggtgatattgatccccttcatcatgagaatctactgctaatacgacgtaatcaccgtttgtgatgaattcttcagttaaattgacgatcgcctcttcaatcattctgccgggctccccgcaggtcaattttccgtcactcgccacaaaatcattcgtataatcaatacaaataagtgcttttttcatagccggcctccccgccatcagtatgagaacattatatcttatctccagttgtaagtgaattgccatgaacaaaaagacaaacggtccgtttgtctcttaagatttcagcactgaccgattataaatgtcgtcctgaatatatatcaattcacgattcacagcgatgtcagccgcaatgacgatgcctaaaggcgtatgaaactgaagatcagatacaatcttgaagggcactccgtaccggttcgccatttggatataaggagagtaagactgatactgaagctctccattaatcaaaagggtgacgttatggctgtttttcagctcgtgctccgcctctttatacggtttgcttctaagcacctgtccttttgtcagtgccaaaacgactctttctcttagagaacctaaaaacaagtggcgctcgtcaggctttgtctccaaaggcccatacattccttgctgcaaatagagatccattttatcttcactcaaaagcctgtcctcccgtcttgtttgtcttcattatcacctgatcaggcaggagctaaactttcaagcgccgtttacatttctgttacccaatgaatgatttttttggccagctcaccagcagggatttcctctgtatgccggcgcaacgacgcttccagccgttcaggcagagttgctttatcttcttcataggaaatgatcgtgctccactccagctgcggtaccgctacaagcgtgcgcagttcttttctgttttcatgcagatacacgtccgtgatcattccggtttgcgtattgatatttgcttttctgattttcataacatgacctctctattcaaagactacccatattatacaataaaaaagcaacagcctcttgtgaaaaggctgttacccgttaaacgaaactgtttcatcagtgatatcggcatctttgaagagagttttactcgtttggttgttaatcttcacaaaatcaccaagctgaaatgtgcctgaccccgcccctgaatgagcgacgcttttgggcgaaatcgcaaatacgtctccaaagcttgccgcggcattatccgtaactgacatgatataaatcggccccacaattgcaggcatttccccacctccgcattgatttacagcatcatatgcaaagagccgataatggtgccctcctattcagctggctttgctttttcttcgagtcgtgaccgctggcgcagcttgatcaaacggacaatattcaggaagaacgccttcactaccgcataaaccggcaccgctaaaatcatgccgagaattccgccgaagcttcccgctccgattaatagcaaaataatcgtaagcggatgggtattcagccgctttccgatcacaagaggagacagcaggtttccgtccagctgctgaacgatgacgaccacaataatcgcaaacagcgctttggccggcgagtccataaaaccgacaatgacagccggcgcggcaccgagaaaaggcccgacatagggaatgatattggtaatcgccatgacaatcccaagaatcagggcatacggcagtccggcaattaaatagccgataaaacacgctgttccgacaaaaagacagattaacagctgcccctggaaatatgccgcaagcgtatcggataaatctttaaaaatctttaagccttctgtccgataagaagccggtagaatttttactgccaaatgcggaaagcggtgtccgtctttcagcatgtaaaaaaggataaatggaacagtaataataacaagcgtgatgtttgtcacgacaccaaacaccgcagataaactggacgtgatattttgcggcaggttttggagaaaacttgtcaatgactgttcaatttttgatatcgatacataatcctggttcatcatccaggtaaaccattgagaatgggacaaatcctttgtcagcgcctgaatctgttttatataatcaggaaggttgttaaacagccctgtcacctgtgaggtgatgataggtccgactgacgctgaaataaaggcaagcaaaccgataaacagtaaatagatcaataggatggataatgtccgcggaatttttttctcaagcaggcggacgaccggattaaatatgaaatacaaaattcccgcaattagcatcgggaaaaacaatgtcgagataaaaacaataaacggctgaaatacaaatgaaacttttgttgctacataaataatcagcaaaacaaataaaatctgcaatgtccaaaaatggacttttgatttcaacaagctttgttcctcctagtttttctttgtctgtcagataaaagaacttataccccatcattgtaacaaaaatgaacccatatcagaactcttaatataatgaaaggagtgttggtgatgaaggccgtgacatacgatacagattcagaactggcttatatctatgttcttcctccgaaaaggaacaggaatatacggtctgaggagcttaaagtcaatgattgtatcctgctggatatcgaccaagacggcaaaattgccggattcgaatgttttggtgaggcagcacacctctgtgccccatttgccgggaaatcccggctatatgtaaaagattcagacggttatcattttcgggtctgccagcatgcttcagtccgttcctgctatacagtgtacggcgtcactttctgtttttcagatggtgactatcaggaatttgccggttttgaccttgacggaacaatgtatcatagtgcgtttttacagcgcttaactgaaaaataggacgtcccggtgtacgcctatttttcatgcgcaagcactgttagacccgctcactgtaatctggggtgacggaaatcatgtgctggattctgatcaaacaaacagaatttcgggctccttcaattgtgatatggtcaggtttaacatcgatcagtctgcctctgaccgtatctcgtactgtctgtataacgaaccttgagccgatgagctttttaatggtctgatagacataaggatcgactaaagagaccagttgcggactaccttggttgaccatatttttatcccctttgtgtgttttatctcagcttatgccgcgcttatggataatgacacaggcttacctgataaaacaaaggggtgcggagattttaggagaatacgtttggaagcggtgtaaaggaagtatcgatgaagcggagacagcgaagaaagctggcgctgttccgtacttatacaggctttatcacggatgcctgggcttggtcgattaattggtccagcttttctattttttttcgtgcggttgaaggatcaatttggcggtaatgatgatggccgcccggctcttcatccagttcgtccgcttttttgacaatctgctgcagtgtgtttttatctaattcgccttcaggcaaataggaatctgtatgaagcaaaatggctagtgcaatctcttttgctgctttcggttcctcgccaagccgaatcagaagtttatgcgcccgttccgcccctttaatggcatgaatgtcatttcttttgtatttctcataatcccactttccgtctgtataccattcataatggccaatgtcatgaagcagtgccgcttttgctgctaaatcaggattaatgtcagccttcacagacagcctgtatgcatgataagcgcaggcaatcgcatgtgccacgccggaacgctgaagatatttttgtgcaattggatgggtgaaaacatccattaatgtaacctttctcatggaaacccctcctttagatatttttagaatcctaacataatttgcagagaaactcaattcttatgtcacatcattttgatcttcttatcatcattgttataccctaaaagcaacgtttcagtcagtatatgcggctgttcaataaaatgcgctggctgtagccttttgtataaaaaaaagagcagaaaatatctgctctacaaaaactctttaatatcataaatgcggccgttttccgtccctttttctagtaaagaaagcagcgtgccggcaataaagtccggactgcgaaggcttcctgtttcatttaatttccggaatcgttcaatgtggtggaaatcctttttcgatgaagaacggatgacggcctgcatctcagtgtccatcactccaggtgagaacgaaatcatgttcactggcagctcttcatcctcctgttcaaatccgaatgtcctcgtaaacatgtcgagcccggcttttgaactgcaatacgcgctccatcccttatatggatttttggcggctcctgaagtaatgttgacaatcgtctttttgccgctgtatgaagcaaaccgttttgtaaacagctgactcaaaagcacgggcgcagtcaggttcagctgataatggcgctgaagctcgtcaagagacgcttcgccggcacgtttgatcggcgttaccattccggcgttattaataagggtaataccagaataacgatctgaatcgatggatgagagcaatgtttcaaattgctgttcagcttcttcgagattgatgaggtctatttgatgctgcgttagtttttcatgagagacatccgttttcgttctggataaggcatggacttcatgccccttttctaaagcctgtaatgcaatggcttgacccagcccttttgacgctccggtgatgatataaagttccattggaaacctccttttccgttattattgtacggcaccgcttttacacaacacaagcacgcggcctacgctttcttgttttcctgcgctgtgacttttgggatgaggaacacgatgcctgcaattccgagcaggatcagtacgacatagatcatcggcagcagcaatgatgatgtttcttgttcatcttctgtttccgttgatgatgtctttgttattggtttatctgcaaatgtaattccaagctgtttcgactgggccgcaatcgtgttggaatcctcggcatttgttgatgtaaacaaatcttttatcagctcggcgtccttgtccttcggtttatcaaaagtgatatccttttgttcctcaggcagttctgttttttcttcatagtaggtatcttcatgcaaataattcgtatcgatttcgatgtcttttttctcatactggtttggcgcgacatctgtattttcttcagtttgggcagcagctgcagagggtatgaaaagggaaaaagagagcatacaaatcatgatccccttttccatgctgcgattacgcttcatacgtttcatcgctttctgctgtgtgttcagccatcagccggataatcagcggcagagccgcggcaatcaccgtaatgatcagcagaactgttattcccattgtaaacaagtgcccagtaccgtactggatgtcgatatatactttcgaaaccggatcttcaaatgtaaagttcggcatgatcaaatcaataagcggtgcgacatagaataggatcattgctgctgaagcaacccagccagggattgatccgaatctgaatgccgtccggatgaaggcagagcttgcgaccagcaatagaatcgtaaacaccgaccacttaatcgtctgatcgtccggcagtgaataaatattcaagccgaacaagctgatcataagtccgacaaggatattcagaattccgaataacgctcctttgacgagaagcggtgcgttttggtaatacgagctgaaatagccgattaacagactgctgatcaacacaatgacaaggatgacaaccggaggtaccgtctgaattttttcttccggaacctctccgctgattttaagcggattcgctaagtaatcatatacatagccattgttttgcccgtctactaatgtatttccgagtatgccgtatacgtcatttcgcacgagtttcgtggaggcgacatttttcccccagttgttgtttaaggtgtcggctttcgcttgaacatcattgacgctttgctgcatgttggttgtgtaatcaatgatgccggactggcgatcagacaatgaacccatcatgtctgacatttgcagcacttcctggccgaccgtatcttggacactcagtgccatggtgccagacagcccatcgttgctgaacgtcgcagattcctgtgttgcgcccgttacaagctgttctgacgcttttgcggcactttcagagattttcgtcagttcgtcgagaacacctgcttgagagtcacggatatagccgctgtagtcgtccgcaaatttggtcatgccgtcgatgaagctgttaatatcctcatctgtttgcatcgtgttgtttttgagagcttcccagctggctgattcttcaggtgtgagagccaggactgatttgacgttgccctgctggccgtcaatagcgccggcttttgcagcactgtcaatcgtaccggataatacagagtcataaacagacaaatatttatagtatctcattaaagcggagatgctttctgtattgatttctcctgaaaattgaagctgatctttattttcaagctcgcgaatcgcactgtaaatcccttcaaactcccgcttccgtttcgcttcgagattttcaagtttaccttcgagctttttcactttgtctttcaggtcatcaatttcatcagtgagaccattcatttgctctgttagttcctctaacttctttttcaactcttcattatgagcagtttctttttccttcagttcttcttcaatttgcttgattcgctcagacgctttgctgagctgttcttttgctttggcgatatcagaaatgtcatcgtttcctggttgctcttggtccccaggctccgtcgtatcttcgccgctaccggtatctcctgaatctccggttccgccttcatttgccagcttgataaattgaagggctgaatcagaagatgcagtctgttcggcagatgtgcccgtttcagtttttccgctgtcggacgcaccatcagaggcatcgccgttctgctcctgaccgtctgttcccttctgctggtcttgatcctgagtactgccgtccgtttgtccgtcattaccggtatcactgctgttattgtcgttccctgtgtcgccctgtgtatcatcgggctttgtactgcccccgtcatcaggtttttctggattatcagtggacggatcgtctggttcagtacccgggtcctccggtgttgggtcctctttttcaggctccttcagattgtctgaaatatcctgaatatcagcagcgatatttttcagttcttcacgctgtttttcaagatcaattttgagttcttcaggatcttcttctttagggtctttatctttatcattgttgtcagaaccatcgtctatgactgggtcgtcccctttcgcaactgtcaatgcctgacgtgccgggacaagcaattcatacacctgatttagtgcagcctgtcttgatgcggcctgatattgttcgattaaattactttggatttttgccatgccaagttcctgctgtgacacttgcccttccctaatttgctgggcgtttgccagcacattactggtttgtccgagctgtgacttcgcttggccgatcccagttgccaatccgctcatgcgttcgctgaactgattcgccttttgctgtgcctggatggcatccagacctgtccggatttgctgctgtgttgaatcctgggctgccaaaagcagctttttctgattttcttgatattccttgtatctttcaactgtatcaatgaattctttcagcgtatttttggcttcctccgctgtagaagctttttcttttgtcgtgccttgcgcttcattcattgatttcttcagctcatcgattaaatctttttgctgtttgatttcacctgctaaatcattagagcttggtttgtaaaagttgtacatgacattctggaattcagattctttattgacgattttgtcaaattctcctctgatgttgtccactttttgcgacacaaagttccagtataaggctgacatttttttgttcattgtcttttgggcatcctcaagctcacgctgaactttttctttgttgaccgcattcaggttatcttgaatgctgaattcaagcgttgctttttgtggatggtctttgtcatagctcaaaatgttttttgagaagtctgagggaatgtagacgatcgcatcgtatttttttgacgcgagaccggtctcagccgcgctacggtttacgaccgtccacgaataatcaggacgttcacccagaacagccgctacttccttgccgaactgggcggatttgtcctcttcatcagactttacctcatcactcaatacgccagtgtcttcattcaccaccgcgatttgccgggtggaattgactgcttttttcgtcgggtcgtctccgataaatcggaaaaacaacaccggcagcagcaaaatgatgatgacggcggatattaacttgatcaagctttttcgttgttctgtcatctagcactctccctttcagcagaacataaaggaatttgaactttttgctccttcccgttttccacaacatatccgaagcccggctgaatctcaggctcctgtctttggtacgggagaggaatgacattttgctcagactttttcatcagcagaatcgcgtggcggatttgcttcatctcagtcgtcaaggagtcatagccttttgagaattcgctgtggtttccgcccgggataaagctgaacccaagatgagcgtatgatttcatgaagttagcgagacgatcttgtattctcgtatcaatcgtctgctggaatctcgttatcccgtcaatcatcagcaccacttgtgagaatcgaagattttgcgcgtctccttggcggacggcttctacatacatggcttctcttgttttgaaaatgtcttctgctgtttcaatccactgctcaatatcttctttcgtttccaaatatgaaacatctgattccttcgcataatgagataagccgcggtcaatcgagtcaaacaggccgatcatttcggtttcatcatcaatcagatgttcgagcatgacttttaggacgtttgttttcccgcgctgagtctggcctaaaatcaggcagtgcttatgcttgcccaaatcaaaatagactgggctgactgtttcttcatgaagcccgatcggtacagataaaggcttgcgttccagcttgaagcggagagaaaattctctcgttgtcaggctctcaggcagcatcggaatcggtgccggctgctccaatgaagcaaatcgtccttgaagtttctgtacgtctgatttcagctcgttgaacatgccgatatcatcatcggcgtcaacaggcaggaacatttgcgcgaaataaagctcttccttttgaatgatgacgcgtcccggaatcggctcaagattgaatttcggacggccgtaaatggaatatccttctgattgatccatgagataatggacaacctttgttttcaagttatttaacaatgactggcggacagcattcacccgcgttgctgtcagcataaagtagatacccaagctttgtccgtctctggaaagctggacaaattccgattcaagctcatgcatctcatccttgactatgtcaaagttgtcaatggtgataaaaatgaatggaagctcttcttcgctcagcgcattgtacattttgatgtggctgatttctttttcccggaacaaacgtttacggcggtcaatttcttctttgatgcgaatcatgaacttttcaattttccttgactggtccatcaggaagtaatccgcggtatgcgggagcttcgctaatggcagcagcgttccgtttccgaaatcaaagatatagacatgaagctcttcaggtgtgtatacgtccgcaaaactcatcaggaacgttgcggctgcaatcgattttccgtagcccgaagagccgaagatgccgatatttccatcttccatcatcttataagcaattggcgcctgtctttgcagatcaggttcatctacatacgcaaagtggaaatggtctttttcgtttgaagggaaaagagtgcgcggaatacgttccgcaagcggcggcagccaagggcttggcagcttctcaattcccatttcatcttggatgcgttcaatttcgtcaactacagcttcgatttcggtttgaacgtcttttttcgcgatatcttcggtatcaacctcagaaagcgggatcagacccgtatctgtaacgatcgcgatttcatcctcggtaccgtagacttcctctaagtaaggcgccccgctccatgcagattggaaaagctcatacacttcattgtttccgacctgcaaatagccgcggcctgttacggtaatgtttgcggcatcgctgtttttcaaaatttctttactgtcggtggcatcctggaccttgagcgctactttaaagcgcgagttactccagatctggtcgtcgatgatgccgcctggcttctgtgtcgccaaaatcaaatgaactccgaggcttcgtccgatacgcgcggcactgacaagctccctgataaaatcaggctcctcgcttttcagctcggcaaactcatcagaaattaagaacaagtgaggcatcgccacttctgctttcccttgcttgtatagctttgtatagtcattgatgtgattgacttgatactggtcaaacaggcgctgcctttttttcagctcgcttttaatggaagcaagcgcacgcatactgaagtttttgcttccttcaatatttgtgatcgtgccgaggaggtggggaatgttgcggaacggctgcgccattcctccgcctttatagtcaattagtaagaaagccgcttcatgcggatgaaaatgcactgcaagtgacaagatgtaggtctggagaaattcacttttccctgatcccgttgtccccgcaagcaagccgtgcggaccgtgtgctttttcgtgaaggttcagatacacaatgtcatctttccctttatagccgatcggcactgacagcgacttcgacgattcacttgtcagccatctttgctgaatgccgatttcttttacttccttcgcatgaaaaagctccaggaacgataccgtttccggaatggaattcgtaatgccgacctggtggttcagcgtccgcagcgtgcgtgagaaccgttcgttgtcctcacgctgatgatgatcgagacggaacggaattcttaccgcttttttcttttgtattaaaatgtcgccttcatgctcattaatgtagcggacaagagttgtaatgttttccgacaagctttcctttgtttccgccgcgacaattgtcgagatgcccagatgctcatgctgtccttctaaatattcgagaatgacatgctcagagatcagctgctgattcgtgatgacaaatacaaaatgcggtttgaactgcagtttttctttgtcatcttcgagatcacgctctctgatcaattcgtaaagtgaagacaagagctgatctcgggtttgctcattataaataaatccttttgcataaatatggggcatttgaaattgcggaagccacttcatccactcccagtctttatactcttcttcatgaaaaataaatacaaaacgcaaatcgtgatagctgttaaagaacgacagctgtccgattagctggtgaatctcatttttcacaatttgcgatttaccgacaagccccatcggaccttctgccaaatcgaccgtcaccggcgcattgcggatatctttatagacgcgctgcatgtgctgcgatttctccatgaggtcatcgatatcacgattcgccaagtctccgccgctcatattgatttcatagcttgacggaactgttcccgtcccaagccgcagctggagataatccttgctttcaagtgatttttcccagatccggtcactgatttcacttgttaagtatttcatttgttcaaatgaaggaaagtgaaattcaagaacctgcttttgcttttcagcaagtgcctgaagctctttccgcttattgtctaagtaaagcttatatacacgctcccgtttttcctcgcgttttttccgctggtttttatcccggaaatattgcactgtcgaggtaatgagagtcatcataaacatcgccaaagaaacgagtataaatatgccgcgcggctggatgatggcaactacgcccatcacgatcagcatcacaagcggaggcaggatgacgagccacagccctctgttggtttgatcgctctcctgagagggaaaactgaaagaaacgcggtcatccggcagatcgtataccatccgcggcgttcttctgtactgcggatattttttctgcatttctgtactcggtttgaccgtttctgttaacgctgtttcaaactgggcataatgaacaatttctaaaaggtcttgttccgtcaccctcatttgcgtgaagttccagaatatctcatcccccggcttgagcggcgtattggcgttgattttctctccgttcaagaagatcgttccgctttcaggtcggaccgaccagctgccgcctgcacgaagcaaagaaaacgtgctttgttctgcaaatgcaaagtcttgcggattcagataaatatctgcattcgttttttctgaggaacatacaatttcatcccggtttcccgtaaaataaacggatttctcaggttcactgcccgtcaatatcaagcgtatatcctgctgatccgtttggagagtaaatgatatatccgcctcaatcgtgccgagacaatcatttcccaggaaaacttcgtattggccgccggattcctttcttttaagagaaatcactccgctattaaatggaatggagctgatcgtaacagaatccttcacatcaggccctatggtcaccggatgagacgacgggaggttagacagatttaatttttgaacgttattttggtaaaaaacccataatagactcaaatggcgaacccccttacggccgaatggcagcatgcgatgacctgcgcttcatgtctcacgttatttgtcatcttttttctcatctttcttttctgtttcttttttctcgtcttcttttttcttctgttcttcttttttcgctttttcctcggctgcggctttttcttctgccgctttctcttctgcttgtttttcttcgtctgtttgtgtctgttcttcgcttgtatcgactaacgatgtttcagaattagactgtttattttcttgacgttctttttgcgctttttcaagctcactatttactgagtcaagttctttttgtatgtcttcatcatttgtatcctcagataaaagctgctgtttatatttagctagggcaaagtaaatataatcattgtattcaagcttacggccgatactgatcgcttctttgtattctcctcgaccataatcaatccaatataagaaatgctgagggtctgattgaagggtgactaaattattttctatatttttggtttttgcactccccaggttttcgacctcaacataggacgtcgccagctgatactgcaccgattcaggcaggctttccgcatcgtacttggacagtgtgctgatgacttcactgtactgcttgtttaagaacgcacggttgctgtccactatcgcttggtgctttggctgcgcgaaaaataaggcgtacatcgaataaataagtgccggtacaagcaaaacaatgagccccaagccgatatatcgctggatgttccacttctttctcgggatatgtatgtatgtttttgctttggcttcgagctcatcaatatgggtttgaatcagctcgagcaaatcatcataggattcagcatctaatatcgcctttgcctctgcggagaacgtcagcgtttcattgaatttcaggtagtcttcaaacgcaaaagcgccgtcaactgccaaagccgctgccgctttcagctcctgccatactctttcctcatcacgctcgtaaggaggaatgctttcttttactccataatggagaaaataaggcgtaagccctttatcgaatacaatgttttcaggagcgacaatcaaattcagcctcgacagattgtgctgctgtacggcttgaacaagctgataggcaaactgccatttactttttttatccttagctttcatgaagcggaatgctttataggaggagggaggttggattgtgatgattacttcatcatccgtcacatcgatttctttatgaaaaaatggatttatatctttgatcacgttagcttcaagaccgtcgagaagctttattttttcccgttgaaaggtaaatgtatagccggcatctgttttctcggcaacagcttctaattggttttctaaatatgatttttgttcacctgacattcaaccagatcctttcataatatttcaagccggtctccgtttgtaatgccgcaatcagacagcttgcattctccggaaaacaccttatccttgttcaccactctgatccagtgcccttcgcgcggaggcatagatacgctttgggcctgccaagcaatatcaattacttttttcaccgggtggtaatctgacaatctgagatcaaagacactgccgttataatgtttcaaatctattgtaatatcaatatacatttaggatcacccttacatagaaagagcgccgtcttcttttgaatcaggcgctccttccctttcatactgttatccgcggatttgatttgcgatgtcttggtcagtagactcaagtgtatttgctgtttgatcaagctgctgattcacatcttgaagcaaatctgacattttgataaatgaaggtttgagctgctcgtattgatctgcgaacgcttcgcttgaagcaccttcccacatgcttttcaaatcagagatcattcggtttaaacgatcaacctgatttaatacttcttggctttcaacgccgtattgcttcgccatcgctcttagctcttcgggtgtgacacgaattaatcctgccatattcctcattacctcctgtgccatcagcctaaatatgggctaattcacttatttttagaacgtcattattataaaaacagtttttcggcatagtcaaacaaatatgttttaattttacaaaatgagtccaatggtttaccccgaatcacttaaaaatgacatatactgtaaagtaaataggtttattttcttaatcttctcttcattctccgaataatccaaaagacccaaataactccccaactcccaaaaaaaacctttcagaaaatttgatgctacagcaccatttctgaaaggttcaattttttctttccttaattagtctcgcctccgatgactttcttagaagattaataggataagctgtcgtattatatgaggcatacaactgtcctgcaaaaaggcgattacaccgccaaatgtatatagaacgtttctctcatgaaattgtttttttgcttctgttctttgttgttgattttcacaaacaacaacaatcataataaaaggaaggggatgagatgtcaaagagaaatcaagcacgaaaagtagggagatttatgaccatgccgaatgatccgtttaaatatagttttgacagacttgaagatgtggctgatcatatcagcgacgttctgcggtgcccgatcaccatagaggatgttaaccacaagctgcttgcctacagtacacacagcgactgcacagaccctgcccggacgtctaccattattggcagaagggtaccggagaaggtgattaacaagctgtggaaagacgggacaattcctgctctcttaaaaacggaccagccgatcagagtcaagcaaatcgatgaagtcgggctgagcaatcgcgtcgctatttcgatttggaaaaacaagcaagtacttggcttcatatgggcgcttgagatccaaaaaacattgtccgatgaagatctgctgacattgcaaatggcagcaaaagcagtgaaaaacaagcttctcaaacttcaaatcagaaaaacgaaaaatgaagaacgcagccaagaatttttctggaaaatgctgaccggacacatccatcaggaggatgatatggcggatgggttccataagcttggaatggccgctccttcagagttttccgttatgatcatccgcataaatggcgagctgactgaaaaaatcgaacagcagctgcaatatttacaggaaacgacccagcaggtttacgtgctgctggcgaccgtagattccaatgaacttattatattaacctcacccaaaacagatcatccttttcaagatttaaaacagtttgctttaagtacgcaaaaacagctgaaggagcggtataaaatagaagacgtttctatcgcttttggcggaatatacaactctatttcttttgtctcccgctcctatcaggaagcattgtccgtcttaaaaacgaaggaacggttcgctgaagagaccaaacattttttcagcttttctgagttaggcatttatcaatacttagatgtcttaaatgaaaaacggaaacaggcgggccattataattactcgctttccaaactggaacaatatgaccgggatcaccagtcaaatatggtagagacgctagagcgctttattgaagcagacagcaacgtgaataccgcttctaagctgttaaatatacacgttaatacgttgaattaccgactcaagcggatcagccagatcgctgaaattgatttgaaaaatgtgaatcaaaaattcaccatctatttagatatcaaacttcggcacatggatttgtgaaatttcacaaatccatgtttttttattttcttaatcaaacaaagaattttccaaaatatcaagctacactaaaaatatcacagatacaggaggagacagatatgatcataggggttcctaaagagataaaaaacaatgaaaaccgtgtcgcattaacacccgggggcgtttctcagctcatttcaaacggtcaccgggtgctggttgaaacaggcgcgggccttggaagcggatttgaaaatgaagcctatgagtcagcaggagcggaaatcattgctgatccgaaacaggtctgggacgccgaaatggtcatgaaggtaaaagaaccgctgccggaagaatatgtttatttccgcaaaggacttgtgctgtttacgtaccttcatttagcagctgagcctgagcttgcacaggccttgaaggataaaggagtaactgccatcgcatatgaaacggtcagtgaaggccgggcattgcctcttctgacaccaatgtctgaggttgcgggcagaatggcggcgcaaatcggcgctcaattcttagaaaagcctaaaggcggaaaaggcattctgcttgccggggtgccgggcgtttctcgcggaaaagtaacgattatcggaggaggcgttgtcgggacaaacgcggcgaaaatggctgtcggcctcggtgcagatgtgacgatcattgacttaaacgcagaccgcttgcgccagcttgatgacatcttcggccatcagattaaaacgttaatttctaatccggtcaatattgctgatgctgtagcggaagcggatctcctcatttgcgcggtattaattccgggtgctaaagctccgactcttgtcactgaggaaatggtaaaacaaatgaaacctggttcagtcattgttgatgtagcgatcgaccaaggcggcatcgtcgaaactgtcgaccatatcacaacacatgatcagccaacatatgaaaaacacggggttgtgcattatgctgtagcgaacatgccaggcgcagtccctcgtacgtcaacaatcgccctgactaacgttactgttccatacgcgctgcaaatcgcgaacaaaggggcagtaaaagcgctcgcagacaatgcggcactgagagcgggtttaaacaccgcaaacggacacgtgacctatgaagctgtagcaagagatctaggctatgagtatgttcctgccgagaaagctttacaggatgaatcatctgtagcgggtgcttaattcacaatgagcttgcagaaagatttctgcaggcttttttattttttaaaaggaaaaaagagaccatttcacgaattatgactatgaagttgatcataaaggaggattcatatggctgttcagcaatatggcgtgttaaaaggcatagtcttagacatgaagcgggaaacagatgatgacagtcctcatttccaagtcaaaatgctcggtgaagagaatacgtattacaggtgcgccatcaatgtgatgtccagttctgaggaatctgaagtattgtatttggctgacgatcagtttgattcgggctcaattaccatccttccgaacatgccgtatggatatacaaggatcaatgaagcaaaccgtgaagtggcactggattatgtgcggggcaatttgtttgacccgcgggaaatgaagcctttgcctcatgaaatcacaggacctgataatgatttaaatgattttattgaaacctatatgaagaaagcacaagatgagaaagcgccggtttatatattcggttcaaaattcggccctgaacaggctgcagataaaatattcggctttaccccgactaacggaatgcacaatatccatatgaatcaagggaatgcaatggatacgcgctggaaaaaagacaacggctcttggcatgacgggggtattctgattcagtttgcagatcagtgggccgctgtgtttttagcgtttttatcccaatcttggtgtaccgatgaaaacggaaacccggtcagagattgtgatcatacccaaacgtctgcgtaagatagaaaaagagactgcggcgagcagtctcttcggaagtttgttgacaaaatcctaaagcgttttaaaagctttaggattttgtcatgttttcagcgtgattgaaaacccttgaactctaggaaagatgagcattggagcggagcgaatgttctaattcgtgagcaccaacgcgcagacttggcaacgaatgcgagggtttatcgacacgctgaagagactgcggctagcagtctctttttgatcagattacacattttcaacagtctttaggctgtttggcctcatatcgctccaatgcgattggatatagtccaaacaagcttcacgccctttttgctcatgaacgactgtccagccgcttggcacatctataaaaccgggccatagggaatattggccttcttcattgatcagcaccaaatatgtgccatccgcattttcaaaaggatttgccattctatttctcctcccttatttattcaactcttccagtttgacagcgagaaccttgccgatttgagccagaggttccggctgacataaatctttatgacggcagtcgatgtcgatttgttcaatctgtctgctaatataaggcttccaagagtcaggttcaatcgggtcaaaccattcaggaatgattgttgatctgaaaaacaaaacatttccatggaaggttttcggcttataggaacctaaaatgccgacagaattgacatacgtattcttcaaatttaaaatgaccgtttcatccaggctcgcaagcgcactgccgtcacggcgaagaatctcaatcgccgcttcaaaatctagcggtttgtcccctaagctgtctggatcgtacccgcctaacgccagaagggcaataagcgcttcctcatcatccggtgcctcttttataggaaggaagtggttcggataggcgtccagcatcaccaacagggatacttcttctccttgattttgcagctgggtagccatcgcttgaacgacattcccgcccagggaccagcccagcagatggtatggaccttttggctggaccgttcggatttgtttaatgtaatcggcagccatgtcatcaagtgttttcggaagctcctcgcgctgcccgattccccgtgcctgcaagccgtagattggataatctgttcctatattggtcatcaaaccggcataacaccagctgagcccccctgccggatgaacacagaataaaggaggcttgtctccacttgttcggagcggcagcagaacgtcaagagcgctttggcttgatcccatttcaagtctttcagcgagcccggctacagtaggtgcttcgaacaagttgccgatgctgagttcaacgccgagcgcttcacgaatgcggctcatgagctgtacagcaagcaaggaatgtccgcctaaatcaaagaaacggtcatcaatgccgacacgcggcaagtgaagcacctccataaagaggtcacagagaatttcttcctgtggcgttctcggtcctcgtcctgtcactgccgctgcgaaatccggagcgggcagtgctttacgatcaagctttccattcggtgtcagcggcaattctttcatcatcacaaaggccgcaggcaccatgtaatccggcagtctctcagcagcatatttgcgcagttccgccgtatcaaatgtttcttccgaagggatgacataagctgccaaccgtttatctcccggctgatcctcacgaacgattactgccgcatcttcaagctgcggatgctgaacaagcgcggcttcaatttctcccaattcaatccggaatccccgaattttcacttgatggtctgcacggccgacatagtcgagagaaccgtcagcgcggaggcgggccacatccccagtgcggtacatccgggtgcctggaggaccgaacggatcagctatgaagcgttcagatgttaaaccaggccggcctagataacctcgtgctaaccccgctcctgatacatacagctctccggcaacacccggcggaaccggctgcaggcgttcatccagcacgtatacaccaagatcgggaatgccgcagccgatcaagctgtttgcccgtaaagctgccatgcttcggtctaattcgatatagctcacatgcaccgtcgtttctgtaataccatacatattgataagctgcggtctattttcagggtggcggttgtaccaatcctctaaacggctgagttcaagcgcttctccgccaaaaatgacatagcgcagactgagtgcctgtccgagatccggctgttcccgttccgcctgcataaactgatagaaagcagacggtgtctggttcagaacggtcacaccctctttgacaagcaggcgcagaaacgcttctggcgatctgctgacgtggtgaggcacgattacaagacgtccgccatgcagcagaggaccccagatctcccacaccgaaaaatcaaacgcataggaatggaacatggtccagatatcatctgagctgaaacggaaccagtgctcggtcgctgcaaataaacgtgttacattttggtgaggaatcatcacaccttttggaacacctgttgagccggatgtataaatgacatacgccgtattcaaaggggaaagcggctgagtcctatccttattttttggattacctgcagggtacgtgtttagtttctctgccagctcgggatcatccagcacgattttcggcacgttttcaactggcggaatgtgatttgcagctttagtgttcgtcatgataaacgcaggctgtgcatcttttagcataaaagcaattcgatcagccggataatccggatcaagagggagataagctgccccggcctttagcaccgccaataggccgacagccatttccaacgatcggggcagtgccaatgccacaaattgctccggcccgacaccttcactaattaggaatcgggcaagccgatttgctctttcattcagctctgcatagctcagtgcctgatcttcatatacaacggcaatagcatcaggacgtaaagcagcctgcttctcaaactgctctggcaaacttgcgtgcggaatcttttcagatacactttgccaatctgtcaccatgctgctgcgttcctctggcgcaagaatatccagatttccgatttgctcgtcaggatcagactcggcagcctccaacagccgcatcaaacggtcagcaagagcctgagcagtttcccgcttgaaaagatcagtgctgtattcaagcagtccttccattccgtttggtgtcccgtcagcaaggcgatcttcactgatttccagcgtcaaatcaaacttggcagaaccgacactgttgattcgcaggctactctccatatcaggaagatgcaattcagcgtccggtgtgttttggaacgcaagcatgatttggaataaaggatgcgtcgcacgcgaacgagccggattgagcacctctacaagtctctcaaacggcagatcctgattgtcataggcggccagattcacttcccgtactctgtctagaagctcacgaaagcttgggtcaccggacgtatcagttctgagcaccaatgtattaatgaacagccctacaagatcgcccagcgcatcatcattccgtccagcgatcggactgccgatcggaatgtcggtgcccgccccgagccttgtcaataaagcggcgagaccggattgaagcaccataaacaggctcaccctatttgcgcgagccagctcctgcaatcgcttatgaagctcgggctcaatacgaaaatgaatcgtatctccatcatgactcggctcagccggacgtgaataatcggttggcagctcaagctgatcaggcaggtttttcaaggtttctttccagaaagcaagctgtccggcaatcaagctatttggatcatcctcgtttccaagcagttcttgctgccaaagcgcatagtctgcatactgcacagcaagaggcgcccattctggagatcgtccgtggcagcgagccgcataagccgtcccaaggtctcgggtcagcggtgttaaggaccagccgtccccgacaatatgatggacgagaagaagcagcacgtactcgtcaggaccgatcacaaaaagctcggcacgaaaagcaggttcagctgcaagatcaaagctgtagcgtacagcttcggcaagccgatcagaaagctccttctcagcaatttcagtaacatgtaactcgggacaggcttgatcagcatctaaaatatgctgataggatgtcccctgtgattcagggaagattgtccgaaggctttcatgacggcagacgaggtcataaagtgccgctttcagcaatccttgatccaactcacctgacaaacggacagcaaccggaatattataagtaggactcggtccttccagacaatgcaggaaccatagccggcgctgggcaaatgagagcgggatcttttcaggccgctcagctctctgcaaagcgggacgtgcactctgcgccaaatcaagatgggcagcgagtccggctactgtcggttcgtcaaagagcttggcgataccaagttcggctcccattacctcgcgaatgcggctcatcagacgggctgcaagaagagaatggcccccaagctcgaagaaactgtcatcgataccgacgcgtgccaaaccgagaacctctgcaaacaagtcacacaatatctcttcctgaggagtccgcggggcccgatcactgacagatgtgctgaagtctggtgccggcagtgctttccggtcaagcttgccattaggtgttaacggcagctcgtccatctccacaaacgccgccggtaccatataatcaggaagactggcccccatataacgacgaagctctgcagtatcaatagcagtatcagcgactacataagccgccaatcgtttgtctcccggctgatcttcccgtacgacaaccgcggcctgttcaatgtgcgggtgattggcaagcacggcatcaatttctccaagttcaattcggaatccgcgaattttgatttgatgatccgcccgcccgatataatccaaagacccatcggcgcgccagcgggcctggtctccggtccgatacatccgagttcccggcggtccgtatggatctgcaacgaagcgctccgccgttaaatcagggcgatggaaataacctctggccaagccggttcctgcaatataaagctctccgacaacgcccggcggcaccggctgcaatccattatcaagcacatacacctgcgtgttccaaatcggtttcccaatcggaggaacgccctgcaacccttcttcaagaaaagctgcggcagaccaaatcgttgtttcagtgggaccgtataagttcgtgactgaacaatgaaggtcttgaagcgcctgcaaaagaccgctcggcagcgcctcgcctcctacaagcactctaagcccccgaagtttctcaggttcactcgttaccaaagcgtgccacagtgtcggtgtcgcctgcatgatgttaatatcgaaattttcaatcatttgagctaatgcctgcggctcacggatcgtttcttttcttgcgatcacaattcgcgctccgctaatcagcggaagatataactccaatgctgaaatatcaaaagcgacagtcgtcacagccaacagcctgtcttcttctcctagagaaaacgcctccttcatggacagcagaaaattgtttaagcttttctgtgtcacaacgactcccttcggtcttcctgttgatcctgaggtatagatgatatacgcaggatggtcaagagaaaccgatacatccggattttccggcgaatagcgttttataatctcctgtgtaacagcctgatcaagcacaagctccggtacagccaggttatcaggcagactggctgctatttcctcagtcgttatgatgcatgaaggtttcgcatcctccagcatgtaagaaatgcggtcggctggaaactccggatcaagtgggagatacgccgcaccagtcttgagcacaccaagcattgagaccaccatctcaggggaacgcggcagcgccaaagcgacaaattgctccggaccaatccctttttcgatcaacagacgcgcgaggcggtttgcctcttcattgagctttcgatagttgacttgaatgtcatcacacatgagagcgatacgttctggcgtaagaactgcctgcttttcgaacatgtcctgaaggctgaccagcttctcggattttgccgtctcattccatttagaaatgactttttctttctcctctggcaacagaagctccatttgcccaatcagcatgtcctctccggcagaagccgtttgcagcagctgcaaaatacgctgctgatgaagcttaatatcagactcactgtatacctcgggattcgcatcaacatcaattcgcagcccgctgccgtctgttctgtcatatacattgattgatagatcatcaacaggaccggctgaaagattatgcgttgtgccccggacgccggcaaagtcgagaccgtaatcaaacggcataagattgatttgagggccaaataatctatgattttctcctatcaatttcagatcgcgccgaagctcttcatggcgatacttatgatgtcgccgaatactgcggatttcccgggaaatttgctgaatcagttcagaaaagctcatcgaagagcttaccgtcagccggagcgggagaaggttcatcaccatagccggtacattcagtgacgcggaccctatccgacccatcatgggcaggccgagcacaacatcctcagagccggtcatacggtgcacataaacagctgacaccgcaatcatgacttcatgccagcttcctgagaaatagcgcgccgcttcttttaacgcgtttacatcagacggaggcagatatgccgtatgacgaagaaaactgttagatgttcttggcgcccgatcagccaagctcacaacttcaggtgcatctgcaaaacggtccagccagaattgacgatccttctcatactgctctgatccgcgataatctgtatcctcctccaaaatggcctggagagacccaaaggaacggcctttagctgtttgtccttttataagcgcagtatatgtacttgccacacgctgggctatcagggaaaaaccgaagccgtcgatcgctatatggtgaatgcgctgataccaaaagaaacgatcaggcccggcaataaacagagcttcattgaacaaagggtcataccctaaatcaaccggctttgctaaatcagctttcatccagtttaatgctgttttttccggatcaggctcagagctgacgtcaatgacgtgcagctgtacatccggagacgggtttatcatctgccaaggcccgtccatattttcaccgaagcggacatgcagcgattccgcttccttgatcacgtgccgcaaagcttcttcaaaaagagcaatattgactggtccattgatttctatatattccgctgtattgtagattggattgtccggatcaagctgctgagcaaaccatatgccagtttgcgccccggtcaaagaatattgaagatcttttgtatcaggcatccgtttgtttaccctccttttataaataatccgcgtttggcagcacttgctggctgcgggttgtgagcaatttttgccattcttcgatcgttgggcgttcagccaattccacgaaagtcacctctgccccttcacggcgccattgttccaccaatgtcatgatccttaccgaatcaagaccacgatcgagcaaatcctcttgatctgtgatgtcttccggtgtttcttgtagaagctcagcaatttgtttacggatattctcacatgtaaacacgttctttttgccagtgtttgctgacgttttttgaacgtctgccggcgcattctgcagctgatcaagaagactgtcagtcatcacggtaaacgcacagcgtccagccgcatagtccagcgccatttgatgtttttctaatgaaaaatcagcaactgcatctcccacaaaaaaggctttaatatcctccataaatgcttcacatgctgtaacaagacagccgatatgggcataaattcctgtaatgatcagctgatcgcgtccctctttgcgcatcatttcaagcagattcgttctcttaaacgcgctgtatctccattttgtcagcacaagatcatcatcctctggtgccagctcggttataattttctcctcataaggaccgctgtttaatcccgggccccaaaagtctgtcagcagcgcacggtcatccggattttggcttcccggctgtgcggtatagacaacaggaatcccaagctgaacacattgattcttcagctttcgtatattcgctgaaagctctattaccggagacgctcccgctgtgaaagcatcgacaaaatagttttgcatatcgtgtattaacaagacagcccgattcggatcaggcacccatgatactttgttttgcggcatatcagatgctgtcggcatttgatacggctgaatggcaggtatagccatatgaacacttcctctcaaattgttgttttatttttttaatcctgcaagaagcttctcggaaatggcttcacggagcgcttttttgctgacttttcctacccctgtctgcggaaaggattcgacaaattcaactcgatcagggattttatatgccgccagtccgcgctctctcaaaaatgctttgagctctgcggcttttggggcttcatcccggggaataatgaacacacaagatctttcgccaagaaattgatcaggcatggagaccattgccgcatcatggacagccggatgcgccagcagatgattttccacctcttcagccgcaaccttttctcctccacggttaatttgatccttcgcccggccttcaacgacaatatacccgtctcgtgtcagcctgacgatatcacccgtacggtaaaaaccgtcctcagtaaatgaagcggcgttatgctcttctgccttatagtaacctcgaattgtatacggtccccgcgtcagcaaatggcctgtttcaccaggttttacgtcgcgatcatgatcatcccaaacacgcacttcatcatatggggacatcggttttccttgggtgttgacaatgatctcctcaggatcatccaatctcgtataattgacgagaccctctgccattccgaacacctgctgcagcgtgcagccgaaaacagcttttaccctgcgcgcggcttcagcactaaacttggcaccgccgacctgcaacacttgaaggctggataaatcgtcacggcgtgaggatgccgcatccatccataccatcgcaagaggcggaacaagagcggttatcgtgaccttttcccgttcaattaaaggaaatgcgtcatctggacttggagaaggagataataccactcttcctccagcgtataatacgccgagaacgccaggtgagctcagcggataattgtgtgccatcggcagcgcggccaagtacaccgtgctgtggtcgagccagcagacctccacactccgcttcaggctgtatatgtagtcatcgtgggtcctcggaatcagtttcgatagcccggtgctcccgccagaaagctggaggaacgccacatctgaagatttgacttcaggcagttttacaggttctgtatgcaaatcctccagcggcaaaaattcctctgcctcacctgcgacaatgatgtttttcaaagtcggcagcttgctttgaacctgtctggcaagcgaacggtagtcaaaaccggaatatgcgtcgggaatgatatatgcagccgcttcagcaaactcgcaaaaatatgtaatttcactgcttcgatgagaaggcagtgcgaagactggaagcgcccccagacggaatagcgcgaaaataacttcaaaaaactctttgatatttggcagctgcaccacaacacgatccttctgttgaatgccgagcttctgaaatccggcagccaggcgatcagcccttgtgtccagctctcgatagctccaatgggtgtttccgcatgtaatggcaatgcgatcaccatatttggctgcccggtcccttaacaaatctccaaacgtctcaccggcccagcagccgttctttcgataggtctcagctaactcatcaggccaaggcgtaaatcctttcagcatgttgtatccctccagcaattcattctgttcatatgtgatccacgcccattgcccgcagcattgtccgaaactttgcggacgtctcctgaagctcgtcctcgggctttgaaccggccacaacaccagctccagcatacaggcggagtgagcgttcttctgcttctgcacaacggatggtcacgatccattctccgtcaccggcatcgtcacaccatccgaccatgccggtaaagaaaccgcggtcaaatggttcaatgctgagaatcgcttctcttgcaagatcagtcggtgttccgcagactgctggcgtcgggtggagagccgctgccaattcaagtgcggttacagacgggtcggaaagctctcccttaatcacgctggacaggtgccacatcgtttccgttttgatcagtgaaggcttctccggaacctccagcgtccggcagaaaggtctcagcgctgccgcaaccgcgtcagcgacaaccgcgtgctcatgaagatcctttgcggaagaaagcaattcagctgcccggcgctggtcttcaacaggatcattactgcgcggccttgagccggctaatgggttggaaacgacctgtgttcccatccttgaaacgagaagctccggacttgctccgagcaatgttcggcggggagacgtttcctcctgactggacacgtctgcggcaaacgtgtagccatgcgagttatgctgagccagatggcgaagcaattcatccgtctgaatcggttcaggcgatgtcaaatgcagcgacctggacagaacgattttgctgagtgttccatcggcaatgcgtgccagcccttgttcaacaccatttttataatcctcaggttcaggaacaggctttatgtgatatgtatgcccagcctgctgttccttttcctcatgatcaaattgaagcggtcctgaccagcgcacttcttcaggtacaacgagccgcgctgcttttacttgatcaaaaggaacggccccgacaacaagcggccggctttgccctgattgttttgcctgacgtaacgcctctgcaattcggccagaaagggtttccatttggttttgcccgtctgcctccggtacgatttcacatatgcctttcgctaacagtacacgatgaggagacgctaagaaaaaggcgcccggctgatattcatgaagcaaatgctccgcttttgtttctgttataacgttttgatccaacattctcatgaacctcctttaaattcagttacacgcctaaggtcgcgccgccatctacgcataaattatgcatcgtaatatgccctgcctggccagaaaccaaaaagagcaccgcatccgcaatatccgaaggcttggctagttttttgagcgggatccctgttttaaatgtctcaagtgatccttttatgacttgctccgctccattctcgtcggcccataatgaccactgcatgtctgtttccgttgatccgggagatacaatgttgcagcgaatattgtattctgcaagctcaaggccaaggcatttcgtaaacatcacagccgcagcctttgaggacgcatatgccgccatagatgttcttggtacaccggcagcattcgatccgactgttacaatcgaacccgatcttcggtccatcatatatttgctgactgaacgcgaggcgttaaatacgccagtcgaattcactgagaacgtcgcctcccattcctcatcgctaagcgaatggatcagtcccgggcgaaggacacccgctacattcactaaaatatcaatcggccccatttcacgttcgatgcgcgccgtgatctcatcaatcgccgcgctgtctctcacatccgcaggaaaagcttctgcatggcggccttctgctttgaggctgctcacaaccttttccagcttttcaggattataatcaaccgccgcaatatgtgcgccttgactagcaagcgtccgcgcaacagcttcgcctattccttgggcagcccctgttataaaagcaatttttccctctatactctttgcattcatatcatcaattcctttcttcgctctaaatgccgaacagacatccagcgaaaaagactgctgcgccttgaaaaacgcaatctattgataatgattatcattatcaattataaaaataatcatatccaaatgtcatgtgacagtcaaatataatttcagtgacaaatatttttttaaaggcaaggctgagtatgtctcagcccattgatagatgcggtccgtcagggtgaagcgcaaaacgcagcgccctgctgaccaaaacaggaagaactgaaatatgtccttctcctgaaaactcgcaaaattctgcccgtatgccttgttcagataaaacggccagccgctcataaagctcccttgcattatcattcatccggcttttatgatgctgctctaattctcctgcggcaagcaggatattgataggctgattgtttttcttggtgagagagacgaaatggtccgttttctcgagaataaacggtttattccaatgaatggacggacttcctgcgatatacgtttgaaacgcatcgggctttgttagcagcacctgcagcacgaaaagccctccgagcgaatggccaaagattgtttgtctttttttatcaatctggtaatctcgttctatctccggttttaaatcctcttcaataaatctgaaaaagccctccgctccgccatgctccggccattctctgccgtcgggcctttccggcagcttcgattgggctgttggcattgtaaaatcccggtggcgtgctgaagagaacggctccgctgtctcatagccaatgccgacgatcactgcagggatcaccccggttttttcgggtcggcgtccctgtattcgaacggcttccgtcatcgttccgaagacagaattggcatccagcagataaatcacaggataaccagtgggtggcggcggcgtactaggtttcgagataaaaatgtgataggtacggttttcattgcgtgaagacatcatacgcacttccgtaccaggaatcgtaaatgcgtttgatgtcccgctatttgtccggtctgttgtttgctctttcatgcagtacgacattcctctccttaaactaaaccgcaatgtatgataatgattttcactatcaactagacacctcaaataataggttttcttccaaagaaagtcaactttttcccgaataaaaaaggcaccttgatcaaataaggtacctgcagactatcaatatggaagtaaaaacctaataaagatgcggattgtcctatttgaaatagaaccttaatcccatgtaaacctttgattttgccaagggtcgcctctcatgtgatagccattccgctcccaaaagccagggtgattttctttcgtaaattggatgccgcgcagccacttggcgcttttccaaaaatatagatgcggaaatacaccccgcagcggaaagccgtgttcaggggttaaaggttcgtcattatgcgcataagccagaagggaagtttccgctaagaaatcatcaagcggcagattggtcgtccagccctcttcagcatgtaaaataacgtagcccgcttcttcttttacacccgctttttccgctatatcacaagcccgcaccccttgccacacattatcaagccttgaccatcccgtgacacaatgaatgtcgttttttgattcataccgtggaaaggctttgacatcttcaaagcttagcagcatcggatggtcaaccaaaccgtatacttgaagattccatttcgtcatatcttcgtaatatgggacatctccggtatgaagcacaggaaatgaagtggtgacgttttgatttggcggcactcttccagattgatcggactgtcttgtttttccgaaatacatatgggcctcctttttgttaacctattttaaaatcatgttgacaatctttttgttctttattactctatgattgtgtatgtcaacctaagggggaacaacgatgaaacaacgtaaacttcgtgcgggagatatggcgctgattggcatgttcgccgcacttatggctgtcggggccaacattacatcagtagcaccctttttacaagtagccggcattccgctttcgatgcagccgtttttctgtctcttggcagctttgcttcttggcagcaaacgagcagcgattgccatgattgtatatgcacttgtgggattggccggagcgcctgtgtttgctcaattttcagcaggcttcgcaccgtttgcagggaaaagcggcgggtttattatctcatacattccggcagcatttgtagcgggatggtttttagaacgaaacattcagccaagtaaaattcgatttctcattgcttcacttatcggaacggcgatcatgtatctcatcggcactacctatatgtatcttgcactgaagctgtggattcatacgccagtgagctacggcacggcttggggctttatgatttggtttatggtaaaagatacagcgctggctgtgatactgtcgtttatcgcaccagcaatctaccgctctattcataaagcaaccggctttaacagaaatcacatatcatctacgtaaaaaccgttctattggacggttttttatcataacgagaaaaggctccccagtaaaggggagcctttttcctataaaacaagcgctgcaatccagccaaagatgacaagcggaatattataaaatataaatgtcggcacacaagtatcccaaatgtggtgatgctggccgtccgcactcaaacctgaagtcggcccaagcgtactgtcactggcaggtgaaccggcatcgccaagcgcagcagcagccccgataatcgcaatcgttgccatcgggctgaatccaagctgcatgcatagaggcacgaaaatggttgtgataacaggaatggtcgcaaaagaagatccgatccccattgtaattaataagccgacaatgagcatcagcaatgcgcccaaggactgactgtgtccgataaaaccagctgacgttttgaccagtgactcgacatctccggttttcgtcaatacgtttgaaaatccggctgcaacaagcatgacaaagccgataaaggccattaaaaccattccatcagtaatcagtgagtccgcttcatcacgcttcatcacaccgctgacaaacagaacaatcagaccagcgagcgcccccataatcattccttctactcccaaagtctgagataagtaaagctggacgccgagtgacacaacaatggctagaaccgcgataccaatgctttttctcgtatatggcgatgcttctgcacctgaaatgtcttttgtttcatattgtttcggtttacggtatacgatcactgataaaataaggccgacaaccatacctgcaactggaataatcagtgcgtacggaatatcagcaagcggaacgtttaacccggcatccgccatattgtccttcagcatgccttggaagatttggccgaaacccaccggaagcaaaatataaggagccgttaagccaaatgtaattacacacgcgatcagacggcggtccatttcaagttcattaaagattttcaaaagcggcggaatcagcaccgggataaacgcgatgtgaaccggaacgacgttttgcgaaaaacaagatacaattaaaataatcagcacaatcagcaccttagaaagtgctttttttcgagaatcttccttatttccgattaatttaacggaggcttccaccattgcgtccggaagacctgttttcgtcaaagcggcggcaaacgcgccaagcatggcatagctgactgcaacggtggcatttccgccgagaccgtctgtaaaagctttaaccgtttcgccaagaccgagcccgcctgttaacccgccggccaaggcgcctataattaatgcgataacaatattgacacgcagcaggcttaatacaagcataagcaggactgcgatgacgactgcattcatgatgatacccctccaaaaatcctttagtttgctaatgtagtagataaataaagtacgaacgtatcgtatcataaccgatccactttagtcaactaaagatttcggaagaaaaaatccctgccgcatcatacagcagggatttttcattactcgtttttatcttcttccaatgtaaatcgctccgcaagtgtagccagtgttcttgccataacgccagtagccccggccggcccgaagcaggttgctttattggcagtcgctgttcctgcaatatcaaggtgaacccaaggtgttgactcagcgaattcaccaagaaacgttcctgccataatcgcatgtccctcgcgtcccggtgaattgttgagatccgccatttggctgcttttcacgcgttttttatccttctctgttatcggcagctgccagattgcctcgccgcactcttgtgcagcatcagctacctgctggtaaaagctttgatcatttgtcattgcaccggttgtttcagttcctaatgccacaacgacgccgccggtaagcgtagctacatcgacaagaactgacgcgccatgctgtttcgcgtatgtaatgccatctgcaagcactagccttccttcagcatccgtattaaggatttctattgtttttccgcttaaagatacgatcacgtcatccggcttcatggccccgccggagatcatattatcggttgatggaataacgcacagcacgttttgctcaggacgaagctctccgatcgtttccatagcaccgagaaccgcagctgctcctcccatatctgatttcatgccgacaattccagatttcgttttaatggagtagccgcctgtgtcaaaggtaattcctttcccgactagtccgacgacgtcctcccattcctttttgccctgatatttcaacacaatcattttcggcggttcggtggagccttggtttaccgcaagtattccgcccataccgagctcttccatctctgatttctccaatatctcacactcaaaatcatatttcgccgcaagctcttcagcatacgaagcgaggtcagtcgctgtcagcatgtttcccggcatattcacaagcgttctagccgaatttgtcccttgtccgtatgcctggccgacgcgaagcccggcctgcacttcctgtgtatcttcatctgttacaacatacacggcttcaatttgtttgtcaggctcatttgatttgtgcttataatcctgcacctcataggaagcaagcaggcagctctcagctaaagcatgagcggcatcggctggaggcacgtcttccgaaataaacgtatcaagcaggacagcagtttcttgttttcgatctttatgaatggcttgaaaaacatgagcaaaacgttccttcgcctgttcaaacgaataattagcttctctccccagaccaacgaaataaatccgtttcatacccgcagaagatggagggaatacttttgatacttgattcggtttcgcagagacatcaccctcttttaaaagctgtgtcagatggccttcgagcatttcatcaatttccaacgcttttcctgtcagctggcttttttgaaaaagcccgaccacaagggtttctgtatgctctgattgttgaaccgcataaaacatgaggcttacactcctaacgtaatgggtatttgtaatgaacaatggtataataggaaaaacattctttccactatacttattttaacaaacaacagtctaagacttgcttttttcttttgaaacacgaaggatttttcaaatagaaaggatgtcgccgatggaacttttaacgaattttcctttattatcaagcctggccgcaattatttttgctcaggtcatcaaagtgcccatacagtttatcgtgtccagaaaactggactggtcgctggtcacaagcacaggcggcatgccgagctctcactccgcagcggtcactgcgctttctacaggcgtagccttggagcatggattagactcctcactctttgcggtttccgccattttcgccgtcataaccatgtttgacgcaactggcgtcagacgccacgccggtgagcaggcaacagtcattaataagcttgttattgattttaaccgtttcgtaaatgaagcgaaggacttccctaaggctgcagagaaagaaaagcaaaaaaagctgaaagagcttctcggacatcagccgatcgaagtctttttcggaggcctaacaggtattttactgacattggtactcgcttactttttcatgtaaaaaaacgctcctgctttcgctggagcgttttattctttcacagttttatattgatttctgaacacttgcaaagattttgtttcattgagcttctcaagctcatcctcggtaatctttcccattccctttttaatcacatatacatcaagggtttttttgccccattcattgtatacatctttgactgtctcaaagtacagatcaaggcggtttcccttaatagctgatcctgtgtcggccacaactccgagaccgtagttcggaatgaataaaattgttccgatcgggaaaacggacgggtcagcagcaaccgtggaatataaatcccgtttcactttcacacctgaatatgtaagcccgtataatggatcaccgggatttttgcccgtcgactcagctcctgctgtgtagcctgttgctgttactctttggactggatattcatcccaatcaaatgcctcttctaacggttttgttttatcctcagccgcggacgtggtttgtgtttgtttctgctgcaatgcttttaatgtcagtcctgcatgcttcaagtgcttttcctgatgttcctgcacccattttgacaagtccttcgcttcaattcctgacactgataaaaatgtcgtgccaaatgcaagcagaaataaacaggtcatcagcaaacgtctgatcatattcaacatcattcacctctcctccgaatcattgttcccaagtggagagagcattattcaaaatggtgaatgagctgaacgcataaaaaaagctttctttagaagaaagcggcatttaaaacatttgatatcctctttttctgagcatgttgatcgctataccggacacgatggcgccggccaaaccgctggctaaaatcagcacatcggcagccgctaatgataagacacgatgaaacagactggcaaaggattctcccggcgactggacatagctgatcagcttttctttgctgataatgaaaaggcatacaatcggataaatcacagccataatccaagacattctcagcagcatgtttaataagaaaccgattccaaaaaacaagacaaaaaacaaaacaattgagatgattacgactggcagactaatcaacctattccaccccctgcgttgtttttagtgtaacgcgggggctgaaataaagtcaacggctggaaaaagaatgactgtcttttcctgtcccctggcaagacggacaagtctctgaaccgccgagaatcaattgaaaatatcctttccctgaacaaaatgggcatgcatgtgaagcggttgtcgttgcagttttcatctaatcatcacccttttttctcaattttctgataatataccatatcaagctgtcaacaataaagtcagatcatgtgacaaatcttttgatgtaagcggaaacatacttgttttcctctcgttctctttttattttggcgttttttaataaagaaaacccgcttccgcgggtttttagaaaaacttgaacttgccttttttcaatgtcagtccgagtccgccaatcataaacagcgagcggttatcaatgacttttttcataaacgaagcgggcgtgcctttcagctttctgccataaacaaccccaaccgcgttatgctcgccaagagaagccactgttcccttaatgtccggcttgaattcctcaagctctccgcctttaataagcctgccaaggtttttagcgaccgttatgccctgctgcattgcaatttgcgcagtaggcggatacggacgctctgtatcttcattcataaacagcgagctgtcgccgagaataaagacattgtcatgtcccggggcgcgaagatcagggttgactttcacccggccgcgcatattttcaaaaccggcttcctccacaatcggatggccgcggacacctgccgcccaaacaacggtttgcgatttgatctgctctggttcctcatcttttttgccgactctgactccttccggggtacattcttgtacagccgtgccgatcttgaactcaactccgttttcctcaagataatgtacggcgtaatcaacaagttccggatcaaagcccggcaaaacggtcggcgctgcttccacacaaatgatgcggacaaggcttctgtcaacgtcatattccttacagagctccggcacgcgagcagccagttcgccaagaaattcaattcccgtaaatccggcaccgccaacaacgatcgttaacctgtccggccgtttttccgcttccgtattgtaagtcgcaaactgcagctcaatatgttcccgcagcaggcgcgacgtgttgatgttggcaatcggaaacgcatattcttttaagcctttaatgccgaacgtttcaggcacggcgccgagcccgatgactaaataatcgtactgcagttctccattcgcaagcacaacttttttctcatcaattttgattgcctttacggtatcctgtacaaaattcacccgtgactggttgattacatcttttatctgataacggcagcggtcatgatggagcgtacccgcgctcgcttcatgcatccatgtcgtttcataatgataattgtgtttatttacaagcgtaatgtcagcatcattcggcccgacatacttcgtcagccttgtcaccgtcatcaatccgccatatcctgcacctaaaatcacgattttgggcttattcaatgccatcacatccaccttctctttttttgcttttgttagacccataataaaatcatcatttgtgttagcttcagcttattggcgggattttatgaaatatattgaaaagttttttgtgaagtccttacccgtagcactattatcatgtttatccggctggcccaagaaacattcagaaaaagatcatttcatttggttattatcgtagcggcctgcggaaatattttcaagaacggatgggcacgttagatccttacgattttttctgctgactcgtcaatttgaacggcaatatggtataattaataacaattttcatttaggaggcaattttcgtatgcgagaggatacaaaggtttatgatattacaattataggcgggggaccggtcggcttattcaccgctttttacggcgggatgagacaggcaagcgtcaaaattatcgaaagcctgcctcagctcggcggacagcttagcgccctataccctgagaagtatatatatgatgtagcgggattcccgaaaatccgtgcgcaagagcttatcaataacttaaaagagcaaatggcgaaattcgaccaaaccatttgtctggagcaagcggttgaatctgttgagaaacaagcggacggcgtgtttaagcttgtaacaaatgaagaaacccactactctaaaacggtcatcatcactgcaggaaacggcgcattcaaaccgagaaagctggaacttgaaaatgccgagcagtatgaaggcaaaaacctccattacttcgttgatgatctgcaaaaattcgccggcagacgcgttgcgatccttggcggtggagattccgcggttgattgggcgcttatgcttgagccaatcgcaaaagaagtatcgatcatacaccgccgcgacaagttccgtgcgcacgagcacagtgtggaaaaccttcatgcgtcgaaggttaatgtcctgacaccattcgtccctgcggagctgatcggcgaagacaaaatcgaacagctagtgcttgaagaagtgaaaggcgaccgcaaagagattttagaaattgatgacttaatcgtcaactacggtttcgtttcatctcttggaccgatcaaaaactggggcctggacatcgagaaaaattccattgtcgtgaaatcaacaatggaaacaaatatcgaaggcttctttgcagcaggtgacatttgtacatacgaaggaaaagtcaacctgattgccagcggcttcggtgaggcaccgacagcagtgaacaacgccaaggcttacatggacccgaaagcccgcgtacagcctcttcattcaacaagtctttttgaaaataaataaaaaaaaggagcttgtgtctgcgacacagctccttttttatttgaagatatttatataattcaatgcagttcctacaaccagcgcaatcacaagggctgcgactacccagatcattgccataataatgcggtcctgaatcttttgggacttcggtgttttttcttcgttttgggccatcttattcgctcctttcctatgtccatgccataaagaaagcctggtgctgaacgaccaagctttgctgaacgtatatcattcgcgttttgatccgctctctaagaccattcgttaaaactatgatacctaaactcaccctgcatgacaagcttcggcacttgcaccacacctgccagcaaatcataatgtttgacatcctaaataaaacagagtacattatagaaggcgaacatttcatatattatacttttaaatattcgtttttaggagtgaaaaccatggaaaacgtatttgattacgaagatattcagctaattcctgcaaaatgcattgtgaatagccgttcagaatgtgatacatccgtacgtttaggcggacgtacatttaaattgcccgtcgtccctgccaatatgcagacgattatagatgagaagctagcgattcaattagccgaaaatggctacttttatgtcatgcaccgatttgagcctgagacacgaattgattttattaaagatatgaacgcacgcgggttattctcttctatcagcgtgggcgtcaaagatgaggagtatgaatttgtccgccagctggcagaagaaaatctgactcctgaatacgtgacaattgacattgctcacgggcactcaaatgctgtcattgaaatgatccagcaccttaaaaaacatttgccggacagctttgttattgctggcaatgtcggaacgccggaagcggtcagagagcttgaaaatgcgggagcggatgccactaaagtcggcatcggaccgggaaaagtatgtattacgaaaatcaaaaccggcttcggcacaggcggctggcaattagcggcgctgcgctggtgtgccaaggctgccagcaaaccgattatcgcggatggcggcatccgcacccatggcgacatcgcaaaatcaatccgattcggcgcaacgatggtcatgatcggttcactatttgccggacacgaagagtcgccaggccaaacgatcgaaaaagacggaaagctttacaaggagtacttcggctcagcctctgaattccaaaaaggcgaaaagaaaaatgtcgaaggcaaaaaaatgcacgtggcgcataaaggctcaatcaaggatacactgattgaaatggagcaggatcttcaatcttctatttcttatgcaggcggaacaaaacttgacgccatccgcaacgtggattatgtgattgtgaagaattccatttttaatggggataagtactaatatgcgaaaagcacccggatttgggtgctttttatgtgtaaaaaaatgttatatggtatattttagtaataaaaaatccttgtttctacattctttcttatcgtatcttagcgtcccccaaaagcttgtccaattaaacttgaaacatcctcctcggccagttcgatttctagtcggtgttaataaatacatgacatcaaattttgaaataagtaactccatttttataatttttccagtagtttcgtaaaacccacctagactccatacctcctattaagaaaaagttatttcattttccaaattatacatttataaacttgtcttcttttccactcgattctttagccatctatatacatttgctatattaatttcaaaaccttttccctctaattttgttagagccactgctcctccaaatacctcttccttatcttcctcttctgatagagcttttgttaccagagaagcttgaagtattgttgaatcaattatcctttgttgttgctcaaccaaagtttgaagttgttcaattgtttgagtttgcaactgcactgttgcatttaaaaatattatctgactcttaaaatgctggacgttagccattaattgctgaatttgaaggtcacttgagaagttcgtatatccaatatcatttaccattgatggtagctgcaaataaatttctaatgcttcttgtataatgtttaaagcttcatctgttgattctggaattactgtaaaaagtacattatttgcttgatgcgtaatttctgtagttgctttaatacctatattctttaagaattccgaaaaataaataagatattgttcacatgcaacacgaacatgttcagggaattcaaagatactagttagagtaccttccctattttttaaaatcaactgatttattgcttctcttgttacattgttagcgatacgtaaatattcttctaaacaattattagaattattattacaaataaactttaaggaataaccatatatatcagattcaatggtaatatccatccgttttgcgacatcattagcttcatatattaattcttctgtactaaaaatatttttccatttttcagtttcccaagaaaaatcaattaatatttcaaacattttatcatcaggtgaaaaaataaaaaatatactttgtttcaaaccagtaatatccaattcagttgggatttctattgttactgattttttatattcatttgcaagttggatcttattaaatggcatactggttatacttgaaacaacttcatttgcaatgacttcaaaaataatctcaattttataagtgaagagtttcaccttttctggttccatgatttgtttattaatttctaaaaaaggctcacccttataatctttaattataatcattatcttctcctcctttcagacttactttcatcgctcctttagcgctctatatatagtcgtttgcttatattatttaaactgtattaagcttattctcccttttattcctactaccgaataagtctaagggcatgttgattttcttttagtatatttcccctgtctttatttgtaaactcctctcttcttaacttcttcaattcatttgggtgcatcatatttaagataattggcataatcctaaaaattcaggagaataagtcgtttacatttcaatctcgtagtgtttgtgaagccaagtaacaaggagctccaattttactctcttaaggtttcctgtctcaagccttttgcatttttacctgccataactacgccaatttcttattccatagttgatttgtaatattaatttttggctgttttcttcctaactcttatttaataagaaaacttctagatatttatgtgattgacattaaatccagaaggattgtaattcacaattcttattatattttgcgcactaaacctcagaattcctcaggcccacctacatttgttgctttcttgaacaaagaatcgcagacgcagacgaccagtttacgatagatgaaaatacgaccatagcaaggtttatatacgatatgcacaagtattggtgttcgctatcctgccgccgaagtattcccctaactttacctaggttacatacactttaaagtacaattttcacaatatgaaatctctatcccgctctttaattctttctaaaaagaaatacttatatatttttcaatgcttttccattattcttgccatttgttttgcatttggattttcttcattttgcaactgttcaatgatgttcatataatccgtttcatttcggttctggcttaatttatatgccgcttgaatgtcttccaccttaatcttaaatccaacgatacctttcaattcacgttctaagagttttggagaaagcttatcccataaaacaggattgtcacgatgtttttcgtatttctccagcatgattgttaattcttctgctaattcatctttctctaacatacttgcttttccatacatgtggacagcctgataattccacgtcggaacattttcgcgcgaataccaggaagaagaaatataagcgtgcggtccctgaaacatcacaagcacatcttcacaggcttcaaacgttctccactgaggatttccataagcgaaatgccccgtaatatagtaatgatcatcttttttattgaatcctaacggcaaatgtgtggcaattggttttccttgttctgttgtgacaaccgtaccaaaggagttttcttgtacaaaattccaaatttcttcagcatttgtgactttaaaatattttggaatatacatcatcatccacccttcgaaaaatattatatgagtgttttagccatgattaaatccgtttgttcttcatcacccatataaaaagagtgggcgccggtctgaacaaaccccattttcttataaaaggcaatagcattttcatttttttcccacacacctagccaaatgttctttttattacgttccagcgcaatttctatcgctttattcagcagatgtttgccaagcccatttttttgaaagctgttctttatataaattctctcgatttcaagtgattcagcacccatttcttcagactgagcatcatcgatattgacctttacatatccagcgatttcatgatcaaagtaaataaaaaagaattgcgaagacatattggataactctttttccagctgctcagtgttaaatgcactttctaaataggctttcatattttcaggtgagttctgttctttaaaagtgtcattgaatgtttcaatactcaattgttgaagtgtttgtaaatcttcccggctgcattttttcatttttacactcattgttcggattcagcccctttatttaaaattcaattgtcttgtgtccctttttaatatatttaaacacggaacagatactgaccttgttaccattccaaaaatcttcttcatcatcaactccctatcgtgattttgttgcaaatgcaataaaatataccccgcattaaatatagcgtaactttgctgtatttacaacaaaaatcaaacaacaaatcagcgtttctcttgccgaagtccccggtactctctgcatcatttccccataataaaaacgcctcccttaacgatgatttatcgctaagaaaagcgtcagtaatagttgctatccgtttttagtgcttagcactcttcaggcttgcctgcattcgttgctgttctgaacgaagaaccgcagccgcatgaagcgatggcgtttggattgtcgatggtgaagccgccgccgagcatggattgtttataatcaatcacggtgccgttcatgatgtcaaggctttctttgtcaactagaacagtgatgccgtgctgatcaaacacactgtctgattcactcttttcatgctcaaagcccatgccgtaagaaagtccgctgcagccgccgcctttgacgcctacacgtagaaacgcgttttcttcttcatgctctttcatcatatcttttatatgcaaagctgctgcttctgtaattgttaccgggttgctcatcattgtgaacctccttttaaaaaccggttgctgtcttttattataaacatgatcgtcccaattctcaaacaaggtgttttacaagaaatagacaccctcacaaacggtttcagccggccctgtcatcattacatggccgttatctttccagtttatcaccaaatccccgcctgctaaatgcaccgtgatgtcttgatttcgctttgatacgccgtttaatacagatgcgactgccgctgcacatgctcctgtcccgcatgcctgagtaatccctgatccccgttcccagacgcggaaatgcaattcttgttcattcacggtttcaacgaattccacattgatgccttccggaaatctcggatctttctcaatcaccggccccagtgtcgttaagggtgcctgttcaatgtctgcgatcggaaaaacgatatgcggatttcccattgaaacggcagtgcctgttagttctacttcaccaaatgccatcgtttcattgattgtgtgctcttccccgccgtcaagcatcgggagctcggattttgtcaagcgcggttcgcccatatcgacagtgaccacattcacttttccgttttcgacttgaacctccgctttcacaagcccggagagagtttcaatcagaaaagatgtttcctcaaccagcttatgctcatatgcgtattttgcgacgcagcgcaggccgttgccgcagtttttcccttcagatccgtcattattaaaaatccgcattttaacaggcgcttggtctgatgggcatatcaggatcattccgtcggatccgatccctgtataaacagaagaaacctgaattgcaatctctgacagtttttcttctggaagctgttcttcaaattgattcacataaatataactgtttcccaggccgtgcattttggtaaatcgaaatgagttcataggtgcctccaactttttttctttttcttagtataaaagctattataagcggacacaatacaattatcccccgtttttcatacataaaagctccttgcactgacgcaaggagcttttatcgtttatataaacatgccggcaatggctgcgctgagcagattggctaatgttcctgcaagaacagccttcaggccgagacgcgcgatatctgaacggcggctgggtgctaatccgcccagcgtaccaagcataatcgcaattgatgaaaaattggcgaatccgcataacgcgaaactgataatggtagcagttttcttagaaaactcgccgatgtgcggaccgaagttagaataagcgacaaactcattcagcaccaatttctggccgatatagcttcccgcctgcaatgcttcatgccaaggcacgccaatcaaaaaggcgataggagaaaacacataaccgagaatggattctaatgttacgccttttaaaccgaacaagccgaaagccccgccgagaataccgtttactacagcgattaacgcaacaaacgcaagcagcatcgccccaacgtttaacgcaatttgcagtcctgttgacgctccctttgcagctgcgtcaatgacattggctgcgccttcgccttcatccattttgaaatcgctttttacggtttgcgttttttccgtttcgggtataatcaatttaccaaagactagtccagctggagcagccataaagctggccgccagcaaatattcaatcggaataccaagaagcgcgtacccaaacaaggtagatcccgcaactgccgatagaccgctcgtcataatcgtaaacaactcagagcgcgtcagcccggcaatcaggggtttgatcactaacggagattctgattgtcctacaaaaatattggcagcagccgccagagattccgttttgcttgttccaaggagcttcgacaatccgccgccaatgacacggaaaacgagctgcatgattttcaaatgatataaaactgcaatcagtgctgagaagaaaatgataacgggcagtacacttaatgcaaaggccggactgtctccgacctttagaagcggtccaaaaataaaactgatgccttcattcgcatagtcaatcagaagctgtacacggcttgaaaaccataaaaaaacagcgcgtcccgcttcccatttcaacacgatgtatccaaacgccacctgtgtgcataaaccaacgatgacggttcttatcttaatattgcttttcttttctgaaaataaaaacgcgatagcaatgatcgcaactgcgcccagcagcccccacagaacattcatgaatactcgtacacctcttaaattttatttaaaaaaatatcttttatacgataacaataatattttttgatgtctacacatttttttagttcttttgtacagcaaaataaaaaagggcctgtccaggcccttttctttaaaacattggattttcttcaataaaggtatatatattctcaacaagctcagcaggcgtttcacccatgacgacttctccgtttaccagagcgaaaagcgattccatgcatgtcccgcagtagcttaagcagccatattcaaggacatcaaggttgggatccttctccaaaatcgcccgggcttcctgagagccgtgagccagattgctgacacaaaattcaatcattggattcatgcggtttcacctcacatatgtccattatcgcgaatttttcactattcgtcaaagacaacggatgattcaaaatttattatcgtaacatattatttctcaaataacgttttactaatttgtgttttcaggctaaattgtaggttattttgaaactattattgtgattttagatcaaattcgatataattctagatgttattttacatagttcgtattttcttcaatgtatctatcatactcttcggattaaaggggaattcaaatgaaaaaattggtcttgatcggcggaggttacgggaacatgcgtgttcttcatcgcttattgccaaaccagctgcctgatgatgtttcaatcacgttaattgacagaaatccttatcactgcttgaaaacagaatattatgcccttgccgcaggcacaatttctgaccatcatatcagagtgtcattcccagagcaccctcgcctggatgtccaatacggtgatatcacatcaattgatattgtacaaaaacaagtgctgttccaagatcgtgaaccgatttcttacgatgacgccgtaatcgggctcggctgtgaggataaatatcacaacgtgccgggagcgcctgaattcacctacagtattcaaaccatcgatcagtcccgcgaaacctaccaaaagctgaataatctgagcgctaatgccaccgtcgccattgtcggagcgggcttaagcggcgttgagcttgcaagtgaattgagagaaagccgtgatgacctgaacattattttgttcgaccgcggtaatctcattttatcaagctttcccgagcgtttaagcaaatatgtgcaaaaatggttcgaagagcacggtgtccgcattattaacagggcaaatatcacaaaagtagaagaaggcgttgtgtataaccacgatgatccgatttctgcagacgccatcgtgtggacagccggcatccagccaaacaaagtcgtcagagacttagatgtggagaaggacgcacaagggcgtattgtattaacgcctcatcacaatcttccaggtgatgaacatctgtacgttgtcggcgattgcgccagccttcctcatgcaccgagcgcccagctggcagaggctcaagcagagcagattgtccaaatcttgcaaaaacgctggaatggagaagccctgcctgaatcaatgccgcagtttaagctgaaaggcgtcctcggttcactcggaaaaaaagccggcttcgggcttgttgctgaccgtccgctgatcggccgtgttccgcgtatgctgaaatccggcttgctgtggatgtataaacaccataacggttaatgatagagaagaaccgctgatcaagtcagcggttttctgtatacccatgcttctccatttcctcataaacgtcttttaattttggattgccttcaccgacaattttgtcttctacgagcacaagcggataaaaatactcgtcatttctgattttttccgcaagctctttcgcatgttcattgtcaggcggctcatgaatatcgatgtactgcatctcaaaaggctgatttggatattttcttttcagcgcagcctcaagccactcgtatgtatccttggctgtcggcatattgacacagctcgcacaaacggtttctgccccgtacacgcttagaatgactggtttcatcacttgtagacgcccccttctcctatgtaagtcctttcttttaagtatacagagccaaagggcgtttttatagaaaaaaaccgtttttgtgttgaagtctgaatgtgctataatagggagagcaactttgcaaaccaaacaatagatttttattgttacactgaatataatggttttatgacgacgaaaggagcgaatgtcatgactgaagttgaaatgaaagaacaggtgcaggaagtactggacaaacttcgtccgtttttacttcgtgacggcggtgactgtgagcttgtagacgtagatgaaggtatcgttaagcttcgtcttctaggcgcatgcggcagctgcccaagttcaacaattacgctgaaagccggaattgagcgcgctcttctagaagaagtgccgggtgtcgttgaagtagaacaagtcttttaataaagcagccaggctgatatttgatcagcctggctttttttattagagatattggtcaaaccatgagctgatataattcaggcgcttgatccgctgtcttgggtgtccggtgcgtgacaaattgtgcgatgcattcggaaaacggacaagcttggtttccttgcccatttttttcagagcgataaacagctgctccgcctgctcgatcggacatcggtcatcccgctcgccatgcagtatcaaaagcggtgtctccacgtttgctgcgtattttaaaggagaccggtcccagagcttttctgtgtcctcaaacatgtcatgctcaagctgccagtctgtaaagaaatagccgatatcactgacgccgtgaaagctgatccaatttgatatcgagcgctgggtaacggcagctttaaagcggttcgtctgcccgacgatccagttggtcataaaacctccgtagcttccgcccgtgacaccgagccgcttaggatcaatatgcggatctcgtttgatagcctcatccacagcctgcatcacatcgtcataatcctttcccccataatctcctctgaccgcattcacaaattcctgcccgtagccgtggcttcctctcggattgatataaacgaccgcgtatcctttcgccgccagcacctgaaactcatgaaaatatgtatgtccgtacatcatatgcggaccgccgtgtatgttaagaataagtggatatgttgtctcaccttccatttgtgcaggcctcatcagccagccgttcaccatcacgccgtcttctgtagcatattgaatctcttcaggtattgatatcgtatgctccctgacaaacttgtcattcgcgccagtcagctgtttctcttcctgtccaagcgggatactgtaaagctcactcggtctgtccggctttgtcacactggcaataaagtgctgttcatcaggtgaaagagaaaagctattgatgtactctttttccagacgaatcggatacacaaggccttcaatcgaaatataatagatgcccgtactgccttgatctgtgccgatgacataaaacccttggctgtcctttgtccaaatcgggcgctgttcagcaccaccgatcaatgaatctccaatcagcgcatccgctaaatgaacgtccagcatctcagtaagacatgtgaggcggccttgttcgatatcatagagccacgcctttgagagcgtagcattcttatattccttttcatttccaagcaaagcaagataccttccgtctggtgaaaatgagcttgatccgaatgagccgcgatgaggtgtaacctgcttaagatctccagactccagtgacattatgtaaacatcatgcggcttgctggcatcatctgtttcagttaaattagctgagaaaacaagccatttgccgtcaggagaaaaagcaggatcaccatgatcagctttgtgacttgtcagctcttccatctcacccgactttacgctgacaagcacaagctgggcatacgcacctctcgtcagccctttgccgtcccgtttgtaggagaggccttgcacttcaacaggttcatagctgtcctgctctgttttttctcggtcatcaatgttttctccctctcccaaactgacagtgaccagaatcgattcgccatccggggaccatattggctttgacacgccatacgggatatcagtcagttttctcgcttctccgccttcagcgctcatcatatacagctgtgccgcatcgccttctcgatcagaaataaaggcaagcgtgcacccgtccggagaccatcttgggtcggtgcttcgcttttctccatgtgtccaaggaacagacccgcccgttttcgtttcatagatccatatatttgatgtatacgaatctttctcttgattcacttgtgattttacatatgcggcacgggtgccgtctggggcgtattgaggatcggtcacagagacaatcgctgtgatgtcgtctgcggttatcagctttttcatattcatctcctcctttttacatgtatttcgtttttctaaataaaaactcctttatctccagcaaaaaaagcgccctctgctgacgctgaggaacgcttggcatgatctatacactttttacttgatataaaggatttcgctctattatacttccctctttcgggacggtcaaagcgtctacttcacaatgagggaaatgaagcgcgagctgttcttttagctcttctccctttcctttttcggtcatgacgagaatcgtcgggcctgctccgctgagagccgttccatatgcgcccttcatctcggcgacgtgctctacttttgacagctcaggcacaagcatcgcccggtacggctgatggaacatatccttcttcatgattttcccgacaagcggccaatccttggacatgatcgcagcaatgagtatattgctgacagcacttgcttttacggcgtcggcatatggaaactccttcggaagcacgtctctcgcgtctcttgtcagcacttcgtaaaaaggaatgacaacgactacgtcaatgtcagcattcgggacgcggatcatttgggtctcgtcatcctcatgcaggccgatcacaagtccgccgacgagagaagcgccagcattgtccgggtgtccttcttctagactggctaaatgcagcttgtccgcttcagacagctttaagccgcataattcatcagccagttcaatggccgctacaatcgccgcggcgctgctgccaaggccgcgtgcaagcgggatgtcgctccacaccttcacatggacaggaggtatttcttttccgtacaaatctgcggtccgtttagccacttgatagatcaggttatctgtacccgccggaattccggcgactgtttctgtttcagcctcaaaagaccatttgtcgctttcaaagacggtcagcttcaaatatctgctgagcgccattccgactgaatcaaagccggggcctaggttagctgtgcttccgggaacagtgacagagaacagcatgtcggcttcgttcatacacgggccgctccttttacatattcaaggatgctgtcttcatcagtcggcaatgtgacaggcttgatttctgaaatgtcgaccgctgtgttcggatctttcagtccgtttcctgttaacacagctacgaccttgctgcctttcggaatttctccggatttcacctgtttcagcactcctgcgatagacgcgcaagaacccggttctgcaaacacgccttctacacgggcgatcagctgatatgcgtgaaggatttcatcatcagtgacttcgtcaattttcccattggattcctcggctgcctttacagctttgtcccagcttgccgggtttccgatacgaatggctgtcgctattgtttcaggattttcaatcacttcattgcgcacgattgccgccgcaccctcagcttcaaagccacgcattttcggaaggcctgtgccgtttttctcatgatattccttgaagcccttccagtacgcagtgatgtttcccgcgtttccgaccgggatcgctaaaacatcaggcgcttcccccagctgttcgcacacttcgaaggcagcagttttttggccttcaatgcggtaagggttgactgagttgacaagggcaatcggtgatttctcacagatggaacggacaattttaagcgcatcgtcaaagtttccgtcaattgcgataatctcggctccgtacatgacagcttgagcgagttttccaaatgcaatttttccgttcgggatgatgacaatgcatttcatgttagcacgggctgcatatgctgccgcagcagcggaagtgttacctgttgacgcgcacataatcgtgtcattgccttcttcttttgcctttgccacagccataaccattccgcgatctttaaatgatcccgtaggattgacgccttccgttttgacatgaagctcaattccgagctgctcagacagcttcggcaggtgaataagaggtgtgtttccttcatgtaaagttagcgccggtgtttgatctgttacaggtaaaaattctttatattgatggataagtcctttccacattagctccaaccgttcccttctacacgatatgtgcttttgacttcttgaacgacttccaaatcatttaggttttgcaggatatcactgaaatcagcttctgatgtatgatgtgtgacaattacgatttcagctaactcatcatggcctttaattggcagctgaaggattttttcaaagctcacgccccgctctgagaacacagatgtaattttcgagaatgaaccaacctcatcttttacatgaattcttaaaaactgctgtgcataaatgtcagacggcgatttcatgtttttctcatattgcggtccgacaaagctgttgccggttacacctaggcgcatatttttcatgacagcgacgaggtcagaaacaacggatgtcgctgtcggcatgcttccggctcccggcccgtagaacatcgtctcaccgacagcctcgccgtatacataaacagcgttaaactcattatgaacagcagaaagcggatggtggtcaggaagcagtgtcggctgtacgctgacctcgattttgctgccgtcacgctgagcaatcccgatcagcttcattgtatagccgaggcgtttgctgaagctgatgtcctcgtctgtaatttgggagatcccctttactttgacgtcttccagatccacgttcatcgagaagccgaggcgcgccaatatcgccattttccgtgcggcgtcaagcccttccacgtcagaagtcggatcagcttcggcaaaaccgagatcctgcgcttccttgagcacttcctcatatgggcttttctctttgatcatttttgttaagataaagtttgttgtgccgttcacaattcccatcatttttgtaattcgatctgatgagaggccttcctctaatgtgcgcagaatcggaatcccgccggcaacactggcttcaaagtagatatcgcatccattttccttcgcttcagcaagcagctcggagccgtacacagccattaagtccttgtttgctgtgacaacatgctttttcgatctcagcgcgtcgaccaaatattgttttgtctgttcaacgccgccgatcacctcgatgacgacatcaacatctggatcatcaatgacatcatacacttctgtcgtgagcacttccttcggcaaatctacttctctctttttctctatatcttttacaagcactttttttatcgtaaccggacagccgacctgatgcataagcttatcctgatggtcttgaataattttaacgacaccgcttccgacggtacctaaacctaaaagccctacacgaatcgctttcaaaaaaactccacctttcttttgattgtcctcttgaaaaagacaattgttaactcaacacagacatataagttacaaacattatataagcccgctcctgttttgacaagacagcattaggctgaattttgcgaatgtaaacgcttaacgcattgatatgacaagattctttattttctaattatttttgtcagattttctcctcaccctgagctgcctttgccgagccagctgacgcgtggaacaaacagcttctgcgcccgcatattcatgaattcctgcgctgtattgagaaattgttcataacgcccacagtcattaagaatgaagacaagctgttcttcaaaataatgcttttctgattctgatgacatgtaatagctttctacgatttcaaaataatgaagcgggaaaagcagacggctgtataaaaggcgtttcgaaaatgaagacagcggtgtgacttgctcgtattcctgtaaaaagagaaagccctgctgattaaaatcttgtctgtgatgcaaaaacgtatgcctcatatattcagccaaatcacgggaagcgtggtcaaacacccaatccgccggaatcctgatcaatgattccggtgaccatgtatgcctttccatccgctgatggcatatcgttcctgaatcagcggcttggggcttgtcatccagctcagtgtccactaaatattgtatcgcgttttctgacagtcctaaataatagggaaatgattcgatcatttttttatcgaatggctcatgcggaggggtctgaacctttctctgccaaaatgcttccagctgatcaattcgttttccccacagatccttccactggccgattcttccggccgccttcacctcatatggatatcctcggccttttcggtgaaattccgcaagctccgctccaatggagaacgccctgtttgaataagggggggccgccttcagcagagcgtacgtttttccctcatgttcaaatgtcagttcaccttcttttgtaaagataaaaaccgaaacgtatgggtcactttgttcttgtaaatactgactcatgtaataaagctccgccagctctgtttctgagaattgggaaacggggacaatcagaaagtatgaattaggcgtctgaaagcattgatatgtgtgctggtacatggaaagctgcctgatgtgaatgccgtatttttcttttattgtacctttcaccatgatcacctgcctgttgaattagggctcatcacatcgtagtcatacacagccggaattatgaatacatattttaatccgaagaaggcgcaagaaaaagtcgtaaacttctcaagcattttgtataaactagtaaaaaagattgggtgaagctgatgtcagaaaacgaacaattcagtcagatggaagctaaagcaagagcacggatgaaggagcgcggcgttgaggtatcagacattgccgagcttgtcttttttctgcagaaaaaatatcatccggatttaaccattgatgaatgcacgctgaacgtcaatcgtgttctcgcaaaacgcgaggtgcaaaacgcgattttaacgggcattgaattggatgttcttgctgagcagaaaaaactgtctgaaccgctgcaaacgatgctggaaatagatgaaagcctatatggagtagatgaagttctggcattttccattgtgaacatttacggatcgatcgggtttacgaactacggttacatcgacaaagaaaaacccggaatccttaaacgattgaatgataaatcaaccggtgaatgccatacctttttagatgacatcgtcggagcgatttccgccgcggcttcaagcagacttgctcaccgcgcgcggcatacagaataagggcacccttttagggcgccctttattcaaatgtatggaatccattcagtcagagagtcaatggcgtgagtcggtttttccatatcgtctgtcatatgttctcttttcgttacgcctgtgtgaacgagcagcgtatccatacccgcgttaatgccggccataatatcagtggcatagttgtcgccgaccatgagtgtttcagacacatctgtgccgagaacgcgcatcgcctgctccataataattgattccggcttgccgataaatacaggctgtacacctgtagatacggttaacaccgatgtcagtgagccgtttcccggcagaaggcctctttcagtcggaatcgcaatatctccgttagtggaaataaagcgggcgccatttctgattgccaggcagccgacagcaaatttttcgtatgtaatggaacggtcgatgccaacaacgacaaagtccgcgttttctccgccaaatgtcaggccgttttcttcaatcgcctggcggattccttcctccccaatcacatacacagacgcgtcttttttctgctgtgcaatgtgctgggcagttgccatgctggtcgtgaagacctgctcttctgttgccggaatatcaaaagacacgagcttgtccgctacctgcttcggtgtgcgcgaagagttgtttgtcacgaaaagataaggaacgccgcgatctttcagcgttctgacaaattcacacgcctcctcgattttttccgtgccattgtacattgttccgtctaaatcaattaaataccctttatatgttttcatatccaacactcctgtggctttccagttgttatttaaacgcggaaacaggtcctagctctgtttccaaatagcttctgatccgtttcgggaagtcctgaagagctgtttgatgcgccttgatcagcctgtaaagctcgccgctgtcagcgagcagatactgttgaaccaacgttttgcggtaggcgatcaattttttgagctcatcaccctctttttccgtgacaactttctcatcaacaagtatatccataatgtcgtcatagctgcccgggtcccgcataataaagccgtcaatcatgtcattgcctgtatccaaaatgcattcgattaacagatggcctatacgctgaagtgccaattccccgatttcagactgccagtctgtttgtgagtcaaatagcgccagctggtgctcgaagaaccctagtgttttctcgattttgcttctgtcaacaaaatacatgacagcatcccctttgtgtatatttattttctgatccgtttcaagacaaaatacgcacagccgaaattgcagtattcgtaaatatattcatctaatgtgctgattttcgtttcgaaggttgccttttgattctggtcgtcaaagaagcccttgagccttaactgaccgtatccccagtctcccacaatataatcgtatttatttaatatatcggagtagcgggctttaaaagcctcttcgttgaagccgtctttgaaattgtgcaccaattcaaattcggcattttgaataagaatcatgatctcacctctttttcactcattcctatcataattcattgccccgtccccatcaattgctaaagaataaatcatgcgatttggctaccctacacatgaggagggattgataaatgaaacgaaccgctgtcagcctctgcctgctaaccggactattatccgggtgcggaggcgcaggattggataatgcccaaaatgtccggaatcagacgcagaatcaaaccaaacccgttcatgtgtcggaccgcaacgaggcttttaacaggcataatgagaacgaacaatttggctatgtccgctatcaaaaagaacaatttgacggagaccagcagaaaacgccggtgatgaaccgggaagaaaccgctcacatgatatcaagtttaacggttcagcttccccatattcaagatgctgcgacattggtgaatgaccgagaagcgcttgtcgtatacaaaaccgattctaaaaaccgggagctgaccgccgatcaggtgaaaaaaacagcggcttccgtgataccgcgatactatcacgtgtatatttccgataatccaaaccatatgcagtccgtcgaaaattacagcaatctcggctctggttcaagggatattagagagatcatgtcggggacgattcaagaaatgaaaacctccccgcaaggaagccctgtctcagagaatgaaaatgccaatggagaaacgcgtcaggacatgaaaatcgataggaatgacaaaaacgccagatgatctggcgttttggcattatgcttgggcttgacgctttttagatgcttcgtttacttgttcatccgcatggtaagaggaacggacaagcggaccggcttcacaatggctgaagcctttttgcatcgcgatttcttttaattctgcaaattcatcaggatggtagtatttttggactttcaagtgtttcttcgtcggctgcagatattggccgattgccataatatccacgttgttcgccaagaggtcgtccattacttcaataatctcttcttttgtttcgccgagcccgatcatgatacttgattttgtcggaatgtcaggctgcatttccttcgcacggcgcaaaaattccaatgaacggtcgtacgtcgcacgcgcacggactcttggcgtcaggcggcgaaccgtttcgatattgtgattcaggatgtctgggcgtgtatccattaaggtttttaggttatcgtagtttccgcccatatcagacggcagcacctcaattgttgtgaacgggctttttctgcggatcgcacggacagtttccgcgaaaatgcctgcccctccatctttctgatcgtcacgcgcaacagccgtaataaccgcgtgcttcagattcataagcgcgactgaatccgctacgcgttccggctcttgcagatcaagctcagttggaaggcctgttttgacagcacagaaacggcatgctcttgtacaaacagaacctaaaatcataaatgtcgctgtacgtctgaccgcccagcattcatgaatattcggacactttgcttcttcgcatacggtatgcaggttgttttcccgcatgagttttttgagccctgtatagttttcatttgtatttaatttaattttaagccattcgggctttctgaggtgttcgtctttctttgccaattcccatcatctccaatatccaatatactcaatttctgacacgaaacattctgaaaacgagaaaggtgcagattttagttctgcaacaaaaataatgtttttctaactaaagaaagtcttttctttagacactttaacataggaaaaatttctcgacaagggaagatgattactgacatttttaagccgggttgccgcaaactatgtgtattcaatatgaaaggagattattttgtgaaagttttgttatccgctcttcttctccttttgtttgcatttgagccttctgcgtctggaaaaaagctttcagatccagtgctgtcgaaacggatggaattatatcataaaatcgaagctgtgacgcagatcccttggtatgcgctcgcggctgttgatcaatacgaagaaaacgtgcggagcaaccggaaagatctgcctgaaaaggcgggaatcatcagcatctatatacccgatgatatctggagcgggcctgaaaacccgaatccgaaagatgatgcgccgttaagcattaaagtgtttgacggaatcggaatggatggcgatggagacgggaaagccgaggtcagcaacgatgaagatattttgtatacgttcagccaatacctactgtcgtatggcacagatgaagacaacatccggatcgggctttggaattattaccggcgtgatcagacagtggggattatatctgaattcatgaagctgtttaaagcctacggccatattgatctgggcgagcatgcattcccgcttccgatcagaaccgattacagctaccgaagcacgtggggagatgcccgcggcttcggtggaaggcggattcatgaaggtacggatatctttgcccattacggccttcctgtcaaatccacatgttacggcgtagttgaaatgaagggctggaaccgcttcggaggatggagaatcggcatcagggacattaacaatacgtatcattattttgcccatctcaatgggtttgccaaagggattaaaacaggacaaatcgttgagcctggccaagtgatcggatcagtcggcagctccggatacggcccgccgggaaccgccgggaagttcccgccgcatttgcactatggcatgtacaaagataacggaagaaccgaatggtcatttgatccatacccgcatttgagggcgtgggagcgatatgaataccaaaaaaagaagtaacaaaaagccgcctcttcaacaggcggcttatttgctgcttttttctttttttgaatcggcaccgtcttctttgctgctcggaagctggacagaaggcgtgacacccgagccgccgcttccattataaaactgcggcacttcgccctgcactgctttaatcgatacaggaacattatttgtgacgacagcggttttgctggcaaatggaatgatgaccttcactttaatttcgacaaagatgctgatatcaataagtgcgttatttatgccatacggcttgattttggttttgacatctgtaaaagcgtcaccgattaaattgaaccggaccgggattttcggcccgaggtttccaagaaggctgttgccggttacctgtcccagcggaatgttgatcataatgttttcactggcgccgctgtgtccggtatgggtttccatctctttcaaatgagcctgaagctgctttgtcacttttgttttcacactgtttacaacctgtgtattaaaatcgattgtcgttaagtttccgttttcatcagaattcatttgaaacatatctttcatattttcactgtcagacatatagtcctcaatcgaatcctggatcacctctgtcgctatacgcttcgtttccatctcgccgatgtccattaaaacaggtttgatcgagccattgatcatccaaaggctgaccgttgttgacaggataaaaaagacaacggacaggagcatcacgtaacggaaaggcaaaggtcctctcttgcgaaaagggccgcgatatcttggcaagaaaatccccccttacatatcacaatgtatgcttgtaagaggggacatagtaatagccggggccaatttattttatttcatcatttttaaaagcgcttctctgccgctcatgccgactttgatgccaagatcttccgcagcgtacgtgacggattctaaaggtgcgtctaacagctggtcaatggtgcggacaccaactgcgcgtcccgccacgatgccgcgctcctttaatttttcattcagcagcgccacatcaagcgcgccgcacataatgtatccgtgatcattggcgacggccataaaattcgttttgggaagctttactgtcacagctgtaaaaggctgtccttctatcatgatcggtgtcaggtttaccacgtcaaccactcccttcattcatcactttatgatgaagggcacagcttgttgtgggctgactgccttattgtgcaagcttccaagcaagcagatcccgcaaaaattccggcataaaatattctttttctgcagcgtcgcgaatcaacggaaacagtttgccgagcgtaaacatatcaagcaccgcaacggagtattgtttatgtttttcaatatcttccccgttcagtgtgatccgagtgacgtgggtgatcccgtcatcgagccgtttcgtttctacctcaacgccggcatacaccattttccccatcacttctccgcggaagccgagtcctttgatccggagctgctccatttgttcggaagcggcatggacaatggtttccttcagttcttctcccgtcaggcggacagccaccgggttgatcggatgcggacagatgcggtgcagatccagctttgtcacaggacctgcttttagcggaccgagaatgacacctgaattgaccatactaatgtccgtctcgcaccattcctttaaggcgtatgctaaaagcaaaggcagctctgattcttcaaaccacttcacctcagcatcttgtgcaagctctgcaacggcatcggacagtttctcctcggcttcacgttctttttcattgagaaacgcttttgtttctgcggattctcctgtccattccgccatgttctgcacagaagccgttttgctaatgatgcttcgctgtacgctgtccaccgtgatttctacacagccgacataatggccgtatttctcggcgctggccagcagtaccccattaaccacttgtccatcttcaagcaaatgatgggtatgtgattcgaggattacatcaatctcaggcaccgcttcagccactgcttgatcatcaagaatgcctaaatgtgacagcagaacgataatatcagcctgccctttcacttccagaatggtttcctttatgctttcaagggcatccgtaactgtccatcccagcttgtcatatacaggataatacggcacagttacacctaagaaagcaatggacataccgtttttcaatgatttgatatggtaaggcaccgcccaggacggacggtttccatttttatcaaacaggttagagacgatgacaggaaattcagcatgatcatataagacagcaagctcttcatgcggaagcgtaatcccttcgttattgccgatcgccgctccatcaatgtgaaggcggtttaagagatcgacattcgcttttccgaatgtcgcctctgtcacgaattgaaaacgatcaagatgatcgccaatatcaaaaacgagcgtctcttcgccgtctgactgatgctcttttcttttctgctcgatataatctacaattttcggccagttttcaaaatggctgtgcaaatcatttgtatgatataagcggagcttctccttcataatatctctccctaatcgttcagctgaaaatgccttcataaatgagctggcagccgatcaaaatcaatacgatccgcatgatcataacgatcgttttcgtctgcatttttctgttgatggcggcgccaagctttccgccgaaccaagcgccgggcacaagcgcgagggcgtacagccaattgacgtgcccggaaatcatatgtgaaacagaccctgtcatagaagacaggaaaataataaacatggacgttgccaccgcaaccttcggcggaaacagaaataacagcatcatcgccggaaccatcagtgatccgccgcctataccgaaaagtccgcctaaaaaaccgacaacaaaggcaatggcaataccgacagaggcctgatatgagtacgtataaggctcaccggcatcatcctgaaatgtccggataattcctttgtgcgctttgttgattggccgggctttcgctttcagcattaaggataatgaaatcagaatcataaaaatgccaaaccaaacggaaaacgagtttgaattgaacagctttgacacgtaagccccgatcatgctgccgggacccgaaccgataaagaaaatgagcccgctcttataatcaactgttttatatttaatataagccaaagttgaagaaaggcccgtaaaaataatgaccaaaagcgaagttccaatcgcaacctgcggcgtcacatcctgaaacagctgcgtcactgtgcttaaaaacatcagagatggcacaatgacaattccgccgccaagcccgatcagacttcctaccgtacctgcgattaatcccaggacgaccaaaatcacaaacgacatcaatcaaaacctcttttctaaaataaatcgagctgtctcggagcaagtccgctgtactcgatatcaagcagttcaagcatctgcttgccattatccgcagcgtcaccgccggaattgttgttgaacaggacaaaaacatccttacattgctgctgcaatttattcaggtgctttttccaatcctccagctcctgttggttgtagcggtataagtacctgacctcccgccagtttttcccgccatcaggcttcatccagccctgcttgttgcgtccgtgaaacctgacgagcgttttgttttcatcggtcgcgcgcaacacggtcggaacgctgccttctccgatttgcggttcatcacagacactgtgaatccagccttccgctttcataaatgaaagcgtctgctcataaaatggcggcgagaaccaggaacggtttctgaattcaagcgcgcaaggaatatctcccatttggtgcttgcaccatctcaaataggcgacattctccttcttgcagtcaaaccacggcggaaattgaaacagcaccatggcgagcttattgctatgtaaatatggcgttaaagacaccttaaacgcatcaaacatctcctcttttgagtcaaagggaatttcgccgcgctgatgccctgtcatgccctgatatgctttcacgataaattggaaggtttcgggcgtttccttcacccacttttcattattgcgcgccggctgaatcgcgtaaaagctcgcgtctaattccacgatcggaaaatgggaggaataggcctgcaattttttctggctggccgttttcggcggatagatgctgtcatgatccccccaccccgtcagtccgatataaatcacactcattcacctctcttccagtttatcacacgtgttttcaggtttcctcggaaatgctgttcatatggcgggaaaatgcagaacgaagatgctgatattgttcctcattcgtatctaaaaacgcctcttctcttgaggaaggaatatgctgatattcaataggcgcctgaaactgctcactcgtaaaatcgtacatcacaccattgatgctgttgtaaaaatgccagctctcaccgacttttgttttgaaaatcgtgccgccgaaatggtcttgaatcaccaatgccgtcacgccgcattggccgcatgacgggcattcttccgtccatttagagctcgaatggcgcgaccaggattgcttaagtatgtatttgacatgctccattgcctccgcctcctttaaaaaaagataccacgttgatgagattttaaaaactagaacggaggaaatcaaaaaacccggcggtaaaatccgccgggcttacgaaggaacgaccagagctccgtcaatttcagtgaccttttccccatcattgtacacgcatcggcctttgctgtaagtggcccaaatgctgcagggaaatgtatgtccttcgtaaatgctttttttatgctttgcaaacatcgattctcttgtaacagtgtacggctccatgctgacgagcacgaaatctgcatcacaccccgcctcaagccgcccttttttctgaaggccgaatcgttttgcaggggccgccgctgtccattctgcgatggtttcaaacggaatctgatgctcaagcgccagttccagcattcctaataaagtgaactgcccgccgctgattccgccccatgataaaaacatgttatcctcccgcttcaaggatggacggcagggggaatggtctgaggaaaccatgtcaatgtccccggcaatgagcgtctcgatcagcgtctcttttgattgcagcgaccggagcggaggcgcgcattttgcgacagagcccctttgccgtaaatcgtcatggctgaacaagacataatgcgggcatgtttcaaccgaaacatcaagaccttcctgtttcgcctctctgatcagccggaccgctttcgccgtgctgatatggacaaaatgaaccggacaacctgtcaccttcgcatactgaatcgtgcgatacaccgcttcaacttctgcttcctccgggcgggaggcggcgtacgcatccgcgtccacctttcctttattggccaaaaccatctgcaagtagcttgtaatcgcgtcactttccgcgtggagagcgaggatttttcctgcagccgcgatttctgccatgcctttgagcaatgtccgttcatcaacagagcggaactcatcagtgcctgactttgataaaaacgctttaaacccgatcgctcccgcttcagccatcggacggatgtcctcgatatggcctggcacaaggccgccccatagcgcaaaatccacggcagatttttgcctgcctagctcagcttttgcgagaagatgctctgccgtcacggttgatggaatacagttgagcggcatatcaaaataggtggtgcaaccgcctgcggccatcatttgagaacctgtttcaaacccctcccaatcctccctgcccggttcattaaaatgaacatggcaatctatcacaccaggaaacacgtatttcccgtctgcctggatgatttccgtcccgcttgcttcaatgtcagaacctatctcggcaatgacaccgttttgaactgcaatatcagcttctataacgccatctggcgtaactgccttcgcaccttttatcaccatatcgtaagccatattgatccccccatgtaaggatgacgatttttcatgtcagtttatgtaacacaaccagttctattttcaacagtttactgctactatgatcgtattacatcagcaaaaccgctagaattcctattgaaaattattcaccttaaccaatgtttttatagaaaaggagaatgcgctatgaatatttttgatgtgatgaaaataccggcttttaaaaacgccaatttaatcgctggaaaagcaggaggggaaagagaggttcagcatgtcaatatgatggacgctccggatatcgcagactttttgcataagaatgaattgctcgtcaccaccgcctatcacctgaaggatcacccgcatcaattatctgaactgattcggcaaatggcaaaacgcggctgcgcgggcctcggcattaaaacaaagcgctatctggaagatatcccgaaggaaatcatcgaactggccgattcatatgcgtttccgatcattgagcttccggaacacatccgactcggcgatattgtgaatgccacactcagccatattctcgatatgcgttctaacgagctgcagcaagctatttacgcgcacaaaaaattcacaaaccacattatgagcggcaaggggctgcaatccctcctcaaaaaggtgtcagacctccttcagcttcccgtgctgctgcttgaccagcatgccaaaatgctgtctgcgtctcatcagatttcagttgagaccgaaaagctgaaaggcaccctgaataccgtatccgggccatttttcacttgtttctctacaatctcagatcagaaaacatattctgtcctgcctatttataatcacgaaaaaaactgcggctacctgctgataccggacatggtgcaggcaggcgacaaaggattgatcctcacgattgaacaagcggccaacgtcatttcctttgaactgctgaaggaaaatgcgctgaagcagttcagccggcgggcccgcaatgagtttttcaacaattttattgagcggaccttttcttcagatgacgaaatcaaaaaccgggcgaaagaattcaagctgcgctgggatcaaaaatacatgtgcatcgccggcaaactcgatcgcaatgacgaatcaatcagctttacagaaaatcagctcgcttccgacagcgtattcgaatttcttgaaggtgaattatcagccttcccgtttccgcctcacttctttatgaaaggaaacgtcggcattattctaatcgaagcgacagacagctggagtgaaatgcacgcctcggtgatcagctttttagaacagttccaaacacaggtcagcgctcaatttaaacgaaccgtgtcctttggcatcagcaatatctgccaaaagctcattgatgttcccgacgctttcacagaagcttctgatgctctgcaatcggggcatttgtcgagaagcaccgcatttatccaggtgtatcacgccaaagatgtgcctgagcttctgcgcttgctcccggttgaggatttgaagaaattttacaactccacgcttcagagcctcgctgaaaaacagcaggaggatcaaagcctgcttcatacgctttccgtctatttagagacacactgccaaatttcagagacggcaaagcgtctgtacgttcatcgcaatacggtcatataccgccttgaaaaatgcgaagagcttctgggtaaaagcttaaaagatcctgaaacaacgatgcgtttgcggcttgccttacgtatgcagcggctgatcagctaatgctcgttacattttcttacaaaacgaatcatttttcgtcactttcagcaatcacacctgtctttttcagctactgtatccaatgacacccctcgatcggcacgatatcatgttactaaagttcacatacagggagggactatagtgaaaaaaagatcgtttaaggtgtttacacttagcctgcagcatgtgctcgccatgtatgcaggtgcgattttggtgcccctgcttgtcggcagggcgctgaatgtaacaactgaacagctgtcctacctattggcgattgacctgttaacatgcggcgtcgctacgcttttgcaaaccttgcgcggaacatacatcggcatcgggcttcccgtcatgcttggcagttcatttgtggccgtcaccccaatgattgcaatcggcagcaattacggcattcacgcgatttatggttccatcattgcggccggtgtgttcatctttttgtttgcgcgttttttcggcaagctgactgtgttatttcctcctgtcgtaacaggtaccgttgtgaccttgatcggcctttcacttgttccgacaggtgtgaaaaatatggctggcggcgaaaaaataaacggcagcgccaaccccgaatacggttcgctcgaaaaccttcttctctctgtcagtgtccttgttctgatcttagtcctcaaccgctttctcaaaggatttgcccgaacactgtccgttctgatcggcatcgccgccggaacagcggcagcagcgatcatgggcaaagtcagcttttcttctgttacagaagcaccgttcttccaaatcccgaagcctttttacttcggagcccctgcgtttgaaatcggtccgatcttaacgatgctgatcgtcggaatcgtcattattgtggaatcaaccggcgttttttacgcaatcggaaagatatgcggcagacctttaactgaaaaagatctcgtcaaaggctatcgagcggaaggaatcgccattctcatcggcgggctgttcaatgcctttccttataatacctttgcgcaaaacgccggcttattgcagctgaccaaagtgaaaacaagaaacatcgtcgttaccgcaggctgtatccttgtctgtctcggactgattccgaagattgccgcccttgcatctgccgttcctgctgctgtacttggcggcgcgaccgtcgtcatgttcggcatggtgattgcctccggcgtcaaaatgctcagcacagcggatctcaaaaatcaataccacctcctgaccatcgcatgctcaatcgcactcggcatcggcgccagcacggcccccgggatttttgctgaattccccgctccgattagaattctggtcagtgacggcaccatcactggcagcctgaccgccatctttttgaatctatttttcagcttgcgcgacaaaaaagaattaacagcacagcaaacagaacttccagtattagaacatacactcgcattagaaaaagaggtgtaaaaaagatgaaggaacagcacaatgccttacagctaatgatgctggggcttcagcacatgcttgccatgtatgcgggagccattctcgttccgttgatcgtcggagcagcgatcgggctgaatgcggggcagctgacgtatttaatcgcgattgatttgtttatgtgcggggcggcaactcttttgcagctctggagaaaccgatatttcggcatcggccttcccgttgtgctcggatgcacgtttaccgcagtcggcccgatgatttccatcggaagcacttacggtgtcccatcgatatatggtgccattatcgccgcaggactgattgtcgtcttagccgcgggcttcttcgggaagcttgtccgtttttttccgcctgtcgtaaccggatcagtcgtcatgatcatcggcatcagcctgattccaacggcaatgaataacctggccggaggtgaaggaagcaaagaattcggctcactcgacaacgtgctactcgggtttggcgtcacagcttttatcttattgctgttttatttctttaaaggctttatccgctccatagcgattttactcggtcttatcgcaggaacagcggctgcatatttcatgggaaaggtcgatttttctgaggttttggaggcgtcttggcttcatgttccgtctctgttttatttcggaccgccaacctttgagctgccggctgttgtcacgatgcttctcgttgcgattgtcagcctcgttgaatcgacaggcgtttattttgcgcttgcggatatcacaaaccgcagactgtcggagaaggatctggaaaagggctaccgggcagaaggccttgcgattttgctgggcggcttatttaacgcgtttccctatacagctttctcgcagaatgtcggcatcgttcagctctcaaagatgaaaagtgtcaacgtcatcgccatcacaggaatcatactggtcgcgatcgggctggttccaaaagcagcggccctgacaacagtgatccccaccccagttctcggcggcgcaatgatcgtcatgttcggcatggtcatttcttacgggatcaaaatgctatccagcgttgaccttgattcgcaaggcaacttgctgattatcgcctcttccgtcagcttggggcttggcgctacaacagttcccgcgttgttttcatctcttccgggcgcggcctctgtcttggcaggaagcggaattgtgatcggcagtttgacggccattgcactgcacgctttttttcaaaccaaacagccgaatggcacagacataaaaacgtaaaggaagatgccaatgttcacaatggatgacctgaaccaaatggatacacaaacactgacagacacacttggctctatttttgaacactcttcatggattgcggagagatccgcagcactacggccgttttcgtccctttctgatcttcaccgcaaaatgactggcattgtaaaagctgcggatcgcgagacacagcttgatttaatcaaaaagcatccccggctcggaacaaagaaaacaatgagcgatgactcggtacgagagcagcagaacgcagggctcggcaaattagaacagcaggaatacgaggagtttctcatgctgaatgaacactattatgatcgcttcggctttccttttattttagcggtgaagggaaagacgaaacaggacattcaccaagccctgctggcaaggcttgagagcgaacgagaaacggagttccagcaggcccttatagaaatttaccgaatcgcccgctttcgtctggctgacatcatcactgaaaaaggagagacgcaaatgaaaagaaccatgtcttatggcaaaggaaatgtatttgcataccgaacgtttttaaaaccgctcactggagtgaagcaaatcccagaatcatcttttgccgggagaagcaattccgttgtcggcgttgatgtgacatgcgaaattggcggagaagccttcctgccatcatttacagacggagacaatactctcgtcgtggcaacggattcaatgaaaaactttatccagcgccatctcgcatcctatgaaggaacgacaaccgaggggttcctacactatgtagctcaccgatttttagatacctattctcatatggacaagatcactctgactggtgaagacattccgtttgaagcaatgcctgcatatgaggagaaagagctcagcacaagccacctcgtcttcagaagatcgcgtaatgaacgaagccgctctgtgctgaaagcagaacgaagcgggaataccataacgattacagagcaatacagcgaaatcatggatcttcagctcgtcaaggtgagcggcaactccttcgtcggcttcatccgggacgaatatacgactctcccggaagacggcaaccgcccgctgtttgtctatttaaacatcagctggcaatatgaaaatacaaatgactcatacgcttctgatccagcacgctacgttgcggctgaacaagtccgcgacttggcgagcaccgtttttcacgagctcgaaaccccttcaatccaaaacctaatctatcatatcggctgcagaatattagcgaggttcccgcagctcactgatgtcagcttccaatctcaaaatcacacgtgggatacggttgtcgaagaaatcccgggctcaaaaggaaaagtctacaccgaaccgcgcccgccatacggtttccaacattttaccgtgacaagagaagacgccgagaaagaaaaacagaaagccgctgaaaaatgtcggagcctgaaagcctgatgggaaaactgacaacccatattttagatttaaccagcggcaaaccagcggcgaacgtaaaaattgaattgaagcggctgggcgaaagtattttgaaagaggtttacactaacaatgacggcagagtcaatgtccctctgctggctggtgaagagctggtttccggagagtatgtgatggaatttcatgcaggagactattttgcgaataaaaacgtgaatacggtcgaccagccgtttttaaccatagtcaccgtccgttttcagctagcagatccagatgcacattatcatatcccgctcttgctgtcgccgtttggttatcaggtgtatagggggagttaagaaggaagcccgcctcaccggcgggcttctatttgcacttcaataaacttttgatcctaggacagtacttgaagtgatccccacacttagtgaaacaacagctagaataaacattcacctatatttttcaggataattgcctacgagaaaaatatcctgtagtcctttcatttataaatcgaggtttcaaactaataagtcagctcttagcagccgagctcccttctccaatcctataaacagaccgcgttttttctcgaaaaaatactctgaagacaattgctgcgtttttaatagttttgataacgcgttctctcttacacctttagacaaaatattcattttttcttttttagacttaaatctatgtcgaaaatgatcgttggcatatcttatactatctccactaaaggaggtgacattatgggattctacaattctggtggatacagtggaaactctggttactcaaacggtttcgggagctccttcgctttgatcgtggtgctattcattttgttgatcattgttggagcagctatctttaattattaagtttaactttccttgcctccgccgtatccaacacctccctgtccgacagacgccataagaagtttttatggcgtctttgctatgtgttcactaatctttttctaatcagctttcaagttctacgagatttatcgtgtgttttcccacaacgcttctgcgtcttgatcgcgctgtctgactgaggctaaaaaagtccggcttttaaaagccggactcccgtctacccccgttcaactctcttctaatcctgcaagctgaccgcataatcccgccgtacccggtacaccggcacaaattccccgccagcccttcttctatatcttcgtcagaaggttgaggggtttcccgaaacagtgctttaagcgcaattatcattcctggggtacagtagccgcattggaagcctccttcttccagaaaagcggtttggcagatatccagttcctcttgttgtacgccctcgattgttgtaatggaatggccgtccacttgataagccatggtcatacacgcattggccagctttccgtcgattaaaatagagcaggctccgcagcggccgattccgcaggacacctttgtcccggtcagctgaaattcctttctaagcaggtcactcagatgtgtcgtaggaacggcagcaacctcccactcctgcccattcacggtcatccggaactgttccttttttacaggaaatggcccggcctcttttacgtccattgcttcagcccctttctgtctatcgcttcaagcagctcttctcttgaaatcggcagcttgtttatccagcatccgaccgcatcatgtactgcctttacaatcgccggagtgatggcgattgttccgatttcgccaacaccgcgcggtccatatacgtctcccttcattaagtcttctattgcaatcaccttcatgtcaggaacatctttgattccgggaatcaaatagtgatcgagattttccgcagcataacggccatccgtcattttcgcttcctccatcagtgtgtagccgagtgccatggcagcgccgccttcaatttgacctcgatatccctgcggactgatgaccggacctgccgcaatagcgtgctcacaatctatcaatttgacatcgcctgttaacagatctacctccacctcaacggcagccgctccaaatgagtagaggaaatggccgcccaccacaggatcaggcgttgttggaaagtcaaatgccgtttcctctgccaaagggcctttttcagccagctccttatacgtcaccacgagcgcctttgtgtttttgtcacgcaagcctgcagcgccgggaataagattttccgctgaacagccgctccattctgccgcccgttttttcaactgagctagaaacggcttcttcaaacgctggatcgcgtgccacaccatgcttgtgccgcgggatgctgtggaggagcctgacttcggcacttttgcggtatccccaataacaatggaaatatcctctgcggcacaacctaactcctccatgacaatctgttcaatcgctgctagaatcccctgtccgcattcttcaaatccaaacgaagcagtgattttgccttcactcgaaagagacaaacggcctcctgccgcatccattcggccataccccagcccgccgccgtgcattgtaattgccgctcccgtgcctctttgcagatacccgcagttccggctgcttcttgtaagaatgggagatttagatatggcattcaacacctgtgccgctccgtcagtcggtgcaatccgatgctcaagaggccccaagtcatgcggttttctgatattttttcttctcagctccagcgggtcgatgccgagcatgccgctgagacgatcgagatgggtttcgagtgcaaatgtgatttggttgccgccaaagccccgaaattcccccgccaccccgttgttcgtaaatactgatattccttcagtccggatattcggaatacggtacggccccgcggcatgctcgacagaaaaatctagaacggcaggcccaagcgtggcgtaagcgcctgtgtccgccacaattttcacgtcgtgcgccaatagatttcccgaatgatctgcacccgtttttatcgtaatcttcatcggatggcgcttaatgccagaacgtacagattcctttcgtgtctgatggattttgacagggcgtccgcttttcagggccaaaagcgcagcatacggctgaatattcagctcatccttccctccgaacgagccgcccatcggacttgacacaattctgatcttctcttcaggaatatcaaaaatacgggcaagctggaaacggtctttatagccgtgctgggttcctgcatacatcgtaaaacccccgtcgtcttccggaacggctacgcctccctccgtttccatatacgtatgcatctgccgcggcagctcataggtttcttcaaggactgtgtcagatgcttgaaacccttcttccacatcgccgtttgaaaaaaatgcgcggtggaggatattcccgtcctcatgcagtctttgcgcattcggccgaagcgctttttctggtgaatccatgacttccagctctttatactcaactcgaatcagctccagcgccgcttccgcgatttcttctgtttccgcagcaactgcggcgatcgcatccccgacataccgcaccctgtcctcacataaaaccggctgatcagggatgacaatgccaaatcggtttaagccgggaacgtctttatgtgtgacgacggcctgcacgccttccattttctcagcttttatggtgcaaaccgacacaatctctgcatgaggataagcacttctcagcaccttgccatacagcattcccggaaagctgagatcggtcatatatttcaattcccctgtgaccttatcccttccatccggcctgactcttgacggtttgttgatgatcatttattcccctccctcagccatcagctctgccatgatgacgttggcagcggctttttttctgtatgccgctgacataaaagcatctgaggaaaacggcagctcatggataagtgttttgtacagctcatgcgagtcccaccctggtgccatccatttcgcttcgctgtccaataatctcctaggagtgatatcggcatggccagcggcgaggcgaatgccgccgtctttcaaaaaacgtccagctgcaacagcaaccgctcctgtaaaagcctgacgccttccaagcttgtgataaaatacacgctctccctccgcccgcgggatgatgacacgcgtgacgatagccgttctaaagtcttcctcaatgagccaagcgccaagcggcagcctgattagcttcttttgatatacgataagatcagcatcaagcacaagcagaagcggaatgaaatcaccgattttactcgctatgttgccgccaatcgtggcacggctgcggattcccggtgcggcgacagcggaagcagcgtcactgaaacagccaagcgtgctcttgatcaaagggttctttctgcattcactcagtgatgtgagcgccccgatcgacacgtgggtgtcactggcgctgatccctcgcatctcgtcaatcccttcaaggctgacaaggtgctgtttcggtagagttcctttgtcccactgaagctgaagcagcgtgcttcccgatgcggcacacacatccggagcaagcttctctaaaagcgaataggcctcatcaagcgctgccggcctccataattgaatattcatccttgcttttgtcacttggccgttcaagccatcgccctccttaccatgtcatattcctcgggtgtatcaatatcgtccaactcgccgctatcctttgcctccaaaaccgctcctgctccaagctgtccgcttttcaggagcctgcgagccccttcatctcccgttaacccctttacataaggaaaacaagccgacgagaagtagattggcggggtgaacgcccctaaaaacgatgacacggcaaatggctcaggggccagtgccacaagggcattgagatgatcgacggaaagctgaggctggtcggctaacaaaatgacaacgccgtccgcccccatgctttctgcttttctcaccccgctgctgactgaatgcccctgacccttttctgcgtcttggcaaacgtgcaggctccagcgtttttgaaaaggcggagcgtgatacggcgctcctatccactcaagggaggcatgttctgtccgctcgacgaccagcacgtgatcaaggcgggacgacagagcagttttcaaggaaagtgagccgatgttttctccttttagcggcaaagccagcttgttttgacccattcttctgcttttgccggcagcgagaaacacgccgatcagataggggcttctcatacaaccgctattcgttttcttgtttgaatgatttctgcaactacacttaccgcaatttcctctggaccttccgcaccgattttcagcccgaccggactgtaaaagtgagacggaggatgttttccgttcagcagccgtttcgtgcggtttgccgaacccaacagtccaatataatggaggttttgagaaaataagaagttgatgatcgtttgatcgtgctgataatgatgggttgccacaacagctgcatcatgcggaaaaaattgaaatttgctaagcattcgttccggaaaagcggtgatcagctgatccgcttttggaaaaagagaggatgtacaataagcgggccgccaatccgtcacgataacagaaaaccctgtgtcagccgccaaattggccagcggtacagtatccggtcccgccccaaacagaatgaggcgcggcttcggttcaattcgctgaataaacatgttagtgggtggatcgaaatgcggtaaatgaagcgttgaaacagtacgttgaatatcttgcagaggcgcgtccggccagttgccaaaatgcccgttctccgtcagaaataaataatgggaggattcaatctttataacagaagtgacagctttgcctgaatgaaggcaatccctcactttctcatagtgccgccttttttcctgagtgattcgctctgcatgaacatgaataatgccattgcacccggctcccatgccccaagaaagatcgtcctccgaccgcatgtcgtagggaatcagcgttgatgtgagctgatcgcccagcgcactgattctttggaatacatcttcttccacacacccgccgctcagcaagccaatccgtctgccttttttcttaaagagcatagaggcgcctgcttttcgatacgcggagccttcaacttgaacaattgtcgccagtacagcctcctcctggtcttccaggagcgcatctaacatcgtgtgaaaattccccaatgccgcatcctcctctcgaaaattgccgtgagaaacaactagttcagcgtgattttataggtaacttgtataaagaatagacgatggaagaaaaaatgactcatgatttgtcagaaaatgaaacacatagaaagaggatttgtaaaaagagtcaaacgaagaaaatcagattggagaaaacacgaaatcatatctaaaaagcttgcggagttccgcaagcttttctttacaccgctgcctggcggccagcgttttcatacacatccagcgctgcttggagcgcttttcctgcttcgattcctgcgttatgtctgagaagcacagcctctaacccggcaagcacgaatagcacgttttcttttctgcagctgtaccccatcgtgccgattctccagatcttccctgcgagcgggccgaatgagctggcgatttcaataccgaattgtgccagcagcatgccacggacagactcgccgtcaatgccgccgggaatttcgacacaggtgacaacaggcattttgcagctgtcatctccaaacaatcttagccccattgcctttatccctgctgctaatgcggcttcatggtgccgatgccgctcaaaacgcgcctcaaggccttcttcaagcaccagtctgactccctcacgtaaggcgtacagcatcgtcgtcgcttctgtatgatgattgagccgtctttcgctccaataatcctcaagctggctcaaatcaaagtagttgcttgtgattggccgatttcccgaaagcgcttccctgtcagcttgtgacgcaatcccccgctccacctttttacgagctgcaatcacgtccgccacccgctcattatatgtaatcggcgccattcctgagggcacagacaaacacttttgcgttccgccgatggcagcatcaatcttccattcatcgactttaacctcgcagcccccaatcgttgcgactgcatcgacgataaacaatgcatcctcggtgcggcaggcttcgccgatggctttcagcgggtgaatccgtcctgtcgatgtttctccatgcaccatggccacaattttcggcttcactttttttatctcccgtatgatgtcctccgggtcaaaaaccgttccccattcgcactcaagcatatgaacatttgccccatatcgctcggcgatttcagtcagcaaataaccgaaacggccgtaaatgggaatgagcacatcatcttccggctctatgacactagccagcactgcttcaattcccgcccgtgaagtgccgtcaatcgggtatgcccagcggttttttgtttggaacagctcccgaagcatctccatcgtttcattcataatacctgtaaacgccggatcaaattggccgacaaccggggtgctcattactcttaatacacgcggatcaacctcaacaggccccggcgtcataatcgttcttaacggggtgcataattctcttctgcctgacacagccattcctcctttatcagtaagccagtttgtataataaatcagtcagtgcgcggacgccgatctcaagctgtctggctgacgtatattccttcggtgagtggctgacgccgcctcggctcggcacaaacagcatacaagcaggatagcgccttccgatcatttgcgcgtcatgccctgctccgctcaccatttcctcacagctgaagtcgttttctaatgctgtttcaaaagccgcagccttcagcctttcgtccatcggcacaggctctatccgcatatattcatcaatcacagcgcgaattcctttttgtaggcaaatgccgttgatcaaagcaatcatgtcttgatgaaactgttccagcacatgctgatgctgatggcgaatatcgattgaaaactggacgcggcccggtatgacattggctacattgggctctgccgttatttttccgcatgtcagacggagctcatccggcagctcctccgaccgcagtaacagctcatgaatgatacggctgctggctgcgagcgggtccttgcgccatttcatggaggtggttcccgcatgattgcattcaccctccagcgtgacgagatagcgcctctgccccgcaatgcttttcacaatcccgagatcccgtcctgacatttccaatgtctgtccctgttcaatatggagctcaacaaaagcgctgatatctgtccgatatgctgcctgaaacacacctttgccaaaaccgttctcatgcatcgcatgttgcagcgagactcctgattcgtctcttggctctgctccatcctgtaatgaaaaaacacccgtcatattccctgatccccaataggtcattggaaaacggctgccctcctcctcacataaggataccgcttcgagtgtttttttcggcgctccatatgtctctttgagccgctttatcgcaagcattgctgccagaacaccataggcgccgtcgtattttcccccattgatgacagtatcgatatgtgaaccggttataatgacttcatccggagactgggtgcccgaaagccttccaaacaaattgccgacatcgtcgaatcttgtgtcaagcccgaaagaagacatttccgttttcacagcaagctgtgcgtccatccactcttttgtgtataaaagcctcgttacgccgccatccgcagacgcaccgtattgggcgagccattcaatataatctgtgatgctgttttttactgaaagcttctgcttttccatgtactcccccctctggccgctatggtgacttcattatagaaggaggaacatgatagttcattgacagattaaccaaaaaaacgtttattttttagtcacagtatctatccagcaaccagattcaccctacatgtcacaactattttgatgtaaaggtcaaaaggaaacacggtaaggaagagagccagcaagagcgaaagagagggtcaagctcagcttgccagagaggcgatgtttgcggaacggatgaaaacggaaatgccggcagctcgcaaaaacaggacctaaagatatgggaacaggagatttccgcctcctccaaagggactaatttacaattttaatgaaaaatatacaaaatgacacttctatcctttatttcaattttagataatagacatgatctgataaaaggagggcaagtgatgacaaaaaaatcatggtttctgccgctcgtctgtgtattactgatttccggatggcttgcgccggcagcttcagcaagcgcgcaaaccgaattaagcctcaatgaccgattggcgtcttcccctgcaggaacaggaagccttctctcattagccgcccccgctgcaccctatgctgacacagatacctattatgaaggggctgaaggtaaaacaggagactcgctaaaaagcaccctgcaccgtattattagcggacacacgatgctatcctacagcgaagtgtggaacgcgctgaaagaaacggatgaagatccgagaaatccgaataacgtcatcctgctctatacgaatgaatcgcggtccaaaaacctgaacggcggcaatgtcggcgattggaaccgcgagcatgtctgggcgaaatcccatggcgattttggtacgagcaagggacctggtactgatattcatcatttgcgcccggctgatgttcaagttaacagcgcaagaggaaatatggattttgacaatggcggcactgaatatgcgaaggcacccggaaattattatgacggcgattcatgggagccccgcgatgatgtgaaaggcgatgttgcccgcatgctgttttacatggctgtccgttacgagggtgatgacggctatcctgatcttgagcttaatgataagacaggcaacggctcagctccttatcatggcaaacaatctgtcctgctcgaatggaataagcaggatccggttgacgaccgcgagcggaaaagaaatgaaatcatttatgaaaaatatcagcacaaccgcaatccatttatcgaccaccctgaatgggcggatgagatttggccgtaagaaaaaggtgctccttttgaggagcacctttttctaatacacagcctcttccgtttccgcatcgaaaaagacgacgtggtccattttcactgagagctggattgaatcgcctgcatcgattcgcgtgtttccgtccaggcggaccttgagccgctcgtccccagccatgacatgtactatgagctccgagcccagattttcattcacttccacgttcgcttgaaacactgaatcaaacaactggtcatttcctgtcatttgtgtgatgtgctccggccgtacaccggcaatcatctgttctccggcatatcccttttccttcagccgctttgctttttcttcaggaatatgaagccggatcgaagaatttgtgaaaaacagctcgccatgctgctgttctatgatgcctttcaaaaagttcattccgggagagccaatgaagcctgcgacaaacaaattggccgggtaatgataaatgtcatgaggtttcgccacttgctgaatttccccttcattcatgacgacaatccgatctcccattgtcattgcttcggtctggtcatgcgtgacataaatgatcgttgcctctaatcgctggtgcagcttgctgatttctgtccgcatcgtcactcttagttttgcatccagattagaaagcggctcgtccattaaaaagaccttcggctccctcacaatcgacctgccaagcgccaccctttgccgctgcccgccggagagcgccttcggttttctcttcagcaaatgttcaatttctaaaattctggctgccgcatgaacccgctcggcaatttcctgtttcgccatctttctgagctttaatccaaacgccatattatcaaaaaccgtcatatgcggataaagcgcatagttttggaataccatcgcaatatcacgttctttcggcggaagatcattgacccgctccccatcaataagaagatttccttcagaaatgctttctaatccagccaccatccgcagcgttgttgattttccgcatcctgacggccccaccagcaccaaaagctccttatcctttacatctaaatcaaagtccttcacggttaattgtgagtgatatgattttttgacgtgttcaaatgttaatgaagccatcagaaaagtccccctatcttttgacccgttatttcgtcactggaaacaacttggtctttctgttatttttagagtaatcgattcccatttttgctatatttctaaaataaaaaatgtaaatttgtattataacgtcataatacattataatataaataataggttaaaaggaggctaccctttgttaaacaacggaagttctacacctttatacattcagctaaaacaaatcatcactgatgacatcaaaaagggcgtgtattccccaactgccaagctgcctaccgaaaacgagctttgcaccaagtataacgtcagccgcatcaccgtcaggaaagccattctcgatttagtcgaagaaggctatctgatcaggcagcagggaaagggaacgttcgttaaaagccctaaattaaaacgagagctgatcgctgtaaacggctactcggaatttatggaatcaaccggcaaaaaaccgaagcatcatgtgctgtcccatgacatcattccagcgtcaaaacccatcgccgaaaagcttcaaatccaacccgagagccctgtggttgaattaaaacggattttatataatgatgatcagcctctcacctttgaagtgacgcattatccgcttgatttgtttcccggcattgatacctttattgctgacggcgtatccatgcatgatattttgaaacagcaatacaaagttgtacccacgcacaatacgaagctattaaacgttgtatatgcccaacaggaggaaagcaaatacctggattgtgatatcggggatgcgctgtttgaaattgataaaacggcttttacatcaaacgaccagccaatctattgctcattgtttttgatgcacacaaaccgtgtcacttttaccatcaacagcccctacacataacaggcataaaaaacgagacactgcttatagtattctcgttttttcactgcttcccccgtcctccaagcgataaggatagccatagccgaaagctccgtacacaccgcatgttttcgcagccgtttcggcggcctggcgcaaagcgtacgttatatcctgcttcacgcaaaaggcagtcaaaaagcctgctataaaagaatctcccgctccaagtgtatctattatatcagcttccacaatcggctgatgatagactcgatcacccgcagacaggattgctccttggccccctcgggtcatacaaaccattttggctccgtacccatgagctgttttggcaagctcaccgcattccgactcactcaaatcgcttcctgaaaaaaacgcatacgtcacataaggacagaccctcctcaaataatcatcctcccgattggttgaaaaatcaaatgagacagggaccagcccgcacagctgcggaagatcgttctcaagcctgctgtacacgctcgtatgcagcagatcatgcccgctgataaaagatacatctttctcctgaaacgcgaggcgaagccgggactgaatgccgcctttatttgatctgacaaaaatgcggtccccctgttcatcaagggtgacaatcgccatcccgttttctccgtgcgcctggcggatataatctgcattgacctgctccagcttgagaacgttcaacagatgcgccgcggcttcgtcattgccgacgattccaatataggaagactcatgcccgagccgcttggcaagcacagcaacgtttaaggcatttcctcccgggtaaaatgtttcttgatcctggtagtaatctacaacattatctccaaccgcaatcaatttcatagcgcttcctcctttatccttttacactgccgcttgcaatcccgcggacaaaatatttctgcatcaataaaaatagaataataatcggcgcggctgaaatcgttaaccccgccagcaggacgccccagtctgtctgcagcgcgtctctgaactgcatcagcccggctggaatggtccgtaaattctcatcatctatgaaaataatcgcaaacataaactcattccatgtatggtaagccgtcaaaatgccggatgtcaccaaaatcggcacgctcattggtaagaaaattctgaaaaatactccaaaacttgtacacccatccaaataggccgcctcctccaattcttttgaaatagaaagaaaataagagcggatcaaaatgatggtgaatgggatccgataagccgcatacggcaggattaacgcccaatacgtattgtacaggccaagcgactgaataatagaataaagcggcacaagactgacctgcggcgtcagcatcaatccgccgagacatagcaccaagaagaatccttttcctttaaactcaaaccgggaaaggccatacgctgcccatgcactgataaagacagtgatcacacacgtcagcgccgtaacgatgacactgttcataaaataagaagaaatcccctggttccaggcggaaacaaaattttccggatgccacgatgacggcagcgaccagctgtgctcaaaaatatcgtcagagtttttaaaggcgctcatcaccatccagagaagcggataggcaatcgcaatcagataaagaaacagaaaaacccacacagacgtttctccgatataccattttcgtctaggcttatctttaacctcaatgtgctggtcaggcacaggctccaacctgaacgaatctgtcttcttctgaggcagcatcagttactcctcctttccggttttaaagaacttcatttgcatgagcgataatgcaagcgtaatgattaacacgacagtggcaatcgctgaggcgtagcccatcatatcctttgtaaaggcgcttttatataaaaacgtgctcaagacttctgacgcgtttcccggcccgccgcctgtcaaaatgtacggctcattaaagaccgtaaaggccccggtcagcgtcatgaccaccgcaacaaaagacatctctttcgtctggggaacagtaatatgaaaaaactgctgaattttacccgcgccgtcaagccgggccgcttcatacagttcatccggtattttttgaatcgacacaatgtacagcatcgcaatataaccgacagattgccactgggacacaaaaatgacagaaagcatagctgtgctgtcatccccgagccaggccctcgtcagctgatcaagaccgatggcctgaagcagctgattcaaaagccctgtctccggattgtaaataaaatcaaacaaaagcgcgatcacagtcattgagatgacaaccggcaaaaagaaaacggtacgaaaaaacggcgaccattttctgaccagcttatcctcaagcaccgccgccaaaatcaaaccgccaaatacctggcatacaattgagatcactgcataaagcacattattggtaagtgcctgatagaagacaggatcatgaaataattcaacatagttttttaagccgataaacgttttttccggagaaaatgagctccactgaaacaggctgaggaatacattctcaaaaatcgggatataaacgaaaagtaaaaaaacgagagcgggcaccaaaaacaaataggggattattttattctgattgaccaagggtatctcatctcctttataaaaagaaaaggtgcgaagcttcaccttttctttgatttattcagctgacgccctcacctgctttgctgccttttgaacggctttcatcacctgctgcggtgtcatgtcgccgccaagcatttgctggacgccagttaggtacgcatctgcgacttcaacatcgacatccatatcaaaccatggaaccattgatttggcatcaacaatatgctgaacggcttcacgctgaatggctgttgcattttcttcagtagccgtaccttgcactgcactgtatttcccgacatctttcacgagcttttcgcccattcttttcgacgtcaagaactgcaaaaattccatcgcttccttcggatgttttgttcttgaggaaatcatgaatccttccggcgctcccgttaacgcttctgaagatcctttctgcccgctaatttcaggaaatgggaacatcccgagattaaccggttcaaccagcttgatttccgctgtttccgcatatatcatcgccgactttccgctcttaaattgctgtctcacatattcgtggtcgacggagtttacatgtttattaaagtaaggcatcagctcttgaagcttttcaagtgcttttacgtagccttcatcagtaaattcacccgttttggcgttatagtccttttcccgtgttttttcatcgaccatccgctgattaagcgtgccgatatagtgcgagattgtccaagtcgcctttgttccgaagctgatcggtgtgtagccatgttctttcagcttttttgacacatcgattaattcatcccacgtcttcggggatcaagattcagcttttggaaaatgtctttattatagaagaatgatttagcgtccatttgccacggcacgccatattgcttgttttcataagtaaatggtgtaatttgcgattgaacgagctgtgatgaccaatcggtgtcatttttgtagtaggacgagagatcaagtgctttattgcctctgataaatttaaaagcaaactcatcgctccaagagaagtaaatgtcaggagggctggtggttcccagcatgaccttaattttatctttataggagtcatttaaaacggcttcaatttgtatatcgatatctgggtgttctttttcaaattccttaacaacctcttcaaaataacttttttccggctccttcggccatctgtggaaaaatttcaatgtcacctttccgtccgctgaactgctttggctcgaacagcctgcaatggtgaacatactgacagctgcaatgatcaagaacaacaacattttcttcaaagggttggcctcctctggacattagactataatgttatataacattatagtctaatgcataatggttcctcattttcagatcaatactcaactttccacatgtatcttctatgagataaaggatgatttctcgcctctgccagctcgtctgcatagcttctcagcacacgattgagaacgagcggagcaagatagcctttaactgaatcgtcaattgcagtgaagtcgtaagatgcagcatcaagcacagtgagctttttgccatactttttcgagaaggtaagcgctcgctcttcaagaggtcttgtttcatctaaaccgagcaggatgataaacggcacggattcatcaataatttcaaacggtccgtgaaaatattctccggcatgaatggcgtgggaatgaatccattgcatttccatgagaatgcagatgctgtaggagtaagcgacaccgtagtttgcaccgcttgccatggtataaataatactttctttttcatgggcttttgcaaattgcttggcgttgtcagcttcctgcttaagggctttttcatatacagcctgcaattgatctaagccttcaattgcttgttggaatttcgtattgttttctaatacttgcagggttccaaaaacgatttgatacaaaacgccatagtttgtattgatcgcaagcgcctcatcaccccaatcgtactgggcaacatattgcgcttcctgcgctaaaggagactccggtttaaacgtcatcgcaatcgtaagtgcgcccttgccccttgcaaacgcagcagctttgactgtctccggggtatttcccgaatgcgagcacaaaataacaagagacttttcaccaagctgaacagggttgcgctgaataaattcgttggcgctgtagaggtcggagtttattgattttgactctctgtcaaacacatacttactcggatacataatggcagaagaccctccgcatgcgacaaagaatacatgatcaatggttttccctttcaaatcctgcaagaaagcttgaacctcacgatttacttttgctgtggcctgactcaaatccttcactccccgtttttattatataacgttatataacattatatattgttatattaaagtccgcgggtaggattgtcaatattattttctgaaatttctcaataatttattcgaatgacagacaaagggtcaataagcgaaaaaatgcccaaatcaaaagccagaacttgacttaagctctggcttcgctgttcaatccgcagactgacgtcttatttaaaaaataccttgtctatattgtacttcgagtgctgtgtattgatgatatatgtttcataaatctctctttccattggatcatcaactacacatacctcaattttataaacttcatctctgtgatgtttgatcggtgaaacagtgtcttcgaaatgcttcttaattctctgtcttaactttctggctttaccgacaaacagcagctcgtcatgaatgttgtaaaacataaaaatgccgcctttgtcccttgggatctggtgaaagtcgatgaatccgtgaatcggttttatcttcggctcgttatcattagctgactgctgtcgttcagtgatggtgacattcggtgcgggtatatcaatttttatcaaaatcagttcacgtcctctttttcattaaagataaatgctaacacatacagaaaagaaaagctagaacagctttattatatttgtttgttatgctcttgcttattatgcaagtgctccggctggatgataaggactaaggtctaattctgtctgctttccgagaactagctttgcgagctctgcacccaagaacggtcccatcgtcagtccagaagcacccaaaccgtttgcagcatataggccttgaacattcggcacggcccctacgaccggcagaaaacccggtgtaaacggcctgaagcccactcttgtttcaactgcagcggcatcagcaagacccggtgcaacggctaacgctttgctcaatacttcgtgcaggcctccggctgtcacacgaagatcatcaaggcctgcatcgttttcgtgtgtggcgccggctacaattctgccgttatcaaacgaaagaatgtactgatcactcggcggcattacaaccggccacgatcctgtatctgtatctgtcatttcaaaatgcataatctgcgctttttgaaatgacacttgaaaatgaatgccaagagacttcaatatctcattggcccatgctcccgccgtcacaatgaccgcgtcagccgcaaactgctttgcatctgtttgcacgccgttgactgttccgttttcaaaaagcaaagacgcatttcctttgatgaccgttgcgccgcgtttctctgcagcgcttaaaagcgaccggcacagcgctcttccgttcacacgggcggcaccgctgatatgaaccgattcatagccgtcagctaaaatcggaaacagctttttcgtttcacttgcagacaagcgggtaatgtcgccgatttccggcgcatcctcccgtctcttatacgccctttcctccattttatcgagtttagacgcgtccgtatgaatgctgatggcaccgacacgtttgtatcctgtatccgtttcaccgtctttttccaattgatggattaaatccttatagtaccgggctccccccttagcaagctggtaccaatcctgattacggcgttgcgagagccatggacagacgatccccgccgccgcatcagtcgcttgtcccggctctttccgatcaatgacagtaacgcgagcgcctgattttgcgagatgataagccgtcgacgcgcccagaatccctgcgccgacgatgatgtacgatttcatatgcaaacaccttttctattataatgtctattcattttaccaaatcgaatgctttccttcgaccttttgccctaatgtggaaaaaccgcgaagttcgtccaatctctttactctcctatcgaatatcctgtcactatcaatagagaaaggatgataccatgagcgaaaatcgtcatgaaaatgaagaaaacagacgcgatgcggcagtcgcaaaagtccaaaacagcggtaatgcaaaagtcgtggtcagcgtgaatacagatcaggatcaggatcaggcacaggcgcagtcacaagacggagaagactaatgaacgaaaacatcattcctctcaacagacatactcaagagatacccactactgaatctgttatcaaaaacagcggcaactcagaggtccatatcgacattcacattgatacaatgccaattgcttttgctatattatgctctgcattagccgcaaagcagatgacaaaagaggaattcgatatggcttatactcaattgcgagagatgaacagagaaaataacagcagatcatctgtaaagcaaattatcaatcaggagacagaagaagagtaaaaaaccgcggcccctcggccagcggtttttcttctgcatacaaaaaggacgcgactgaaaaccagtcgcgtcctttttataaaaaaataatcgattgaaccttccatttcgaacttgattatttttataaaatggtacggaatgatttataaaagggtcacccaaacccttgatttaaagccatttcttcagatggtttaaatgatgataatcttaacttggcaccgtgttggcatgagctgaagccgcatgatataagggtttacagtaataattcacggttgccgccgtgagtaagtttcatatcttttgaaagttattattgaagtaatgcacctgttagttgaactattccacggcttatttaaactgtactaatcttttgaaatagaaataccgttctcaataaaatgctttattcatatttaaatttttgaggctactaggcatacatccaaaccaagttttgaccctgagcgtaaactagttaaaagtctaattgcaataaggagtgaacctcgaataatggtatatcaaagacaaatgacaccctatgccctgaatccccgggatttacaaaattgtttgtatcgtttcacgtatttgtggcttagaaataatgataatttctggtatttcttaacggctatcggagaatcaagagtttatggatataggtttttcggtggaagatggaataattattccgttgatttaagagatattgtttccttctattgttctcctccgactccaactctatattaaaacactgagcctgatatttgcatatgaagaaaatatttgtgaattaaaaaaggtcaaagcaaaatgaattgaatcttgaaatatccaggattcaaaaaaacaaagatgtaatcattttctaaaattacaataggcactatcttacacattcgaaactatcacaagcttcaggggttgaatatagaggcttacacgctttcagacacggttggacactagaacactaaaacaataagtgaaaaatattcacacataactgaaaaaatcgaacaagatgagcttgcaaaatttgcttcttactcaacaagataacaaaaagcttggcataaaaattggcacaatagaaacttggcatatgtcgaaaataagaaaaacccttgataaacaagggtttttcgttagttatccaatagaaccttccatttcgaacttaatcaaacggttcatttcaactgcgtattccattggaagctcttttgtgaatggctcgatgaagcccattacgatcatttcagttgcttcttcttcagaaataccgcggctcatcaagtagaagagctgctcttcagatactttagacactttcgcttcgtgctccaatgaaatgttatcatttaagatttcattgtaaggaattgtgtctgaagttgatttgttatccataatgagcgtatcgcactcgatgttagagcgggcgccttccgctttgcgtccgaagtggacgattccgcggtacgttacttttccgccctgttttgaaatcgattttgatacgattgtagatgatgtgtttggtgcaaggtgaatcattttcgcacctgcatcctgatgctggcctttacccgcaagagcgatagaaagcgtcataccgcgcgcgccttcgccttttaggatacaagccggatatttcattgtcagcttagaaccgatgttgccgtcgatccattccattgttgcgttttcttcacagactgtacgctttgttacaaggttgtaaacgttgttcgcccagttttggatcgttgtataacggcagtagccgccttttttcacgatgatctcaacgaccgcactgtgaagtgagtttgttgtgtaaacaggcgcagtacagccttcaacataatgaacgcttgcttcttcgtcaacaatgatcagtgtacgttcgaactgacccatgttctcagagttgatacggaagtaagcttgtagcggtgtttcaaccttcacgcctttaggcacgtagatgaaagaaccgccggaccaaacagctgagttaagcgccgcaaacttgttatcagtcggcgggattacttttgcccagtgctcacggaaaatatcttcattctctttcagcgcgctgtcagtgtctttaaagacgatgccttgtgcttcaagatcttctttcatgttgtggtatacaacctcagattcgtactgagcagaaacacccgcaaggtatttttgttcagcttcaggaataccgagcttgtcgaatgtttgtttaatttcttcaggaacttcatcccaagaacgctctgaacgctcagacggttttacgtagtacgtaatttcgtcaaagttcagtgagtttaaatctccgccccattgaggcatcggcatattgtagaaatgctcaagtgatttcaagcggaagtcaagcatccattgaggctcttctttcatgcgagaaatttcttctacgatttcttttgtcaatccgcgctctgaacggaaaatggaaacgtccttgtcgtgaaaaccatacttgtattcaccaatatcaggcatttttttagccatccattttcactccaatccttttaattgccgccttcttctttcgcgactcctttttcaagtgctttccatgacagggttgcacatttgatacgggcagggaattttgaaacgccttgaagggcttcaatatccccgagatctatagaatcatcatactctttcccttgcatcatatccgagaaaatcttagacatggaaagggcagtttcaatatctttccctttaatcgcctgagtcatcatcgaagcggatgccattgaaatggaacagccttccccttcaaacttcgcatcttccacgatgtctccgtcaagcttcattgtcagtctgatgcggtcgccgcatgtcggattgttcatatccacgacaatgctgtcattcaaaacccctttatttcgcgggtttttgtaatgatccataatcacctgtctgtacaatgtatctaagtttgcattaaaagacatttgtaaaatactcctttgtcttttgaagagcttccacaagcttatcaatctcttcctctgtattatacagataaaagcttgctcttgcagtagcagttacatccagccatttcatcagcggctgcgcacaatggtggccggctctgactgcgattccctccgcatcaagcacagtcgccacatcgtgcggatgaacatcatcaaggttaaatgtgacaagcccggcacgctcttccggcccgtaaaccgttacgccgtcaagctggcggaagcgttcaagcgcataagctgcaagcttgtgctcatggcgggaaatctcatcaagaccgatttcttcgagaaaatcaatggcggcaccgaggccgattgctcctgcaataatcggagtacccgcttcgaatttccacggaagctctttccaagttgattcataaagcccgacaaagtcgatcatttcaccgccgaattcggcaggctccatgttttccagcagggctttctttccgtacagcacaccaacaccagtaggtccgcacattttatgggaagaaagcgcaaagaagtcgcaatcgagatcctgcacgtcaattttcatgtgaggcgtgctttgtgcaccgtccaccacaatgacagccccattgtcatgagcgattttcgccatttctttaatcgggttgaccgtgccgagaacattagatacatgagacaccgcaacaatttttgtgttgcttgtgaccgtttctctgacgtcttctaaagaaatcgttccgtcttcctgcagcggaatatattttaatgtggcgccagttgcttttacagcctgctgccacggaatgatattcgcatgatgctccatgtaggtgatgaccacttcatcaccaggtttcaggttggcgcgcgcatagcttaacgccaccatattcagtgatgtggtcgtgccttttgtgaaaataatctcagccattgacttcgcgttaataaactttcggactttttcacgcgctccttcataaccatctgtcgctctggttccaagtgtatggacgccccggtgaacattggaattgtattggttataatacttatccagtgtttcaatgacagcacgcggcttctgggaagtcgccgcgctgtcgagataaacgagatcatgtccgttcacttgctgatgaaggatcgggaactgttcacgaatatctgtgatattcattacttcactttcctttcgataacagaaactaattgtttcttaacgccttcaatcggaagttcatttactaccggtgcaaggaatccgtaaatgactaagcgttctgcttcttctttcggaattccgcggctcatcaggtagtaaagctgaatagggtccacacggccgacagatgccgcatgtcctgcagttacatcgtcttcgtcaattaaaagaatagggtttgcgtctccgcgtgctttttcgctgagcatcagcacgcgtgattcttgctccgcattcgctttagaagcgccatgttcgattttgccgattccgttaaagatagaagaagcggaatccttcatcacaccgtgcttcaagatatagccttcagaagctttaccgaagtggatgatttgtgttgtgaagttttctgtttgctctcctcttccgacaacaaccgttttcgtatcgccgtatgtgccgtcaccgtaaaggtttgttgtattttcggaaatcgtgtcgccgtcgttcatcaggccaagagcccactcgattttgctgtcgcgtccgcgcgcagcaccgcggcggttcacataagttgtcacaccgcttgacagattatccaccgcaccgtatgtcacgctggcattatcacctgtgatgacctcactgataatattgaagacagcgtctttcgggtttacagtgctgatgtagttttctacatatgttacagagctgtggtcttcagccacaatcagcacgtggttgaatagagctgtatcattgctttcgtggacataaacagcctgaaccggcgtctccacctgaacatttttcggaacataaaggaatgctcctccgttaacaagagccgcgtgaagtgcagttaacttatgttcgtcaaccttcacgccgtccttcataaagtatttctccaccaagtcgctgtgctcgcgtgcagcagtcagaatatcagtgaagatgacgcctttgtctttcaattcttgagaaagagaaagatgtgccggcgtctggtcacgctgtacgtataatgttttatcttcgttttcaatgtcgatcagcgcttttacttcatcagtcaaatcttctaatgaagaaagcggttcgttatccactgtatgcttcgcgaaattcgtgaagttccagtttgtgatttttgttttgtcaggtttcggcatcggcagatcctcagcttgttcaagagcctgtaagcgcaggttcttcagccaggcaggttcttggtgcttttcggaaaagcttttgagatactcctgatctacggatagttttgtacctagtgtcatattaatccccctaacgcttacgcttcttggccaacagtttcgtcttcaatgccaagttcttgtttgatccagtcataaccttctgcttcaagacgctgtgcaagctctgcaccgccggattttacaacgcggccttgcatcataacgtgaacaacatccggagtgatgtagtttaacaggcgctgatagtgagtgatcatcaggcagccgaagttttcgctgcgcattttgttgatcccttttgatacaactttcaaagcgtcaatatcaagacctgagtcaatttcatcaaggatggcgattttcggttcaatcatcattaattgaaggatttcgttgcgttttttctccccgcctgagaagccttcgttaagatagcgctgagccatttcagggtccatttcaaggaactccatgttttcgtccattttgcggatgaatttcatgagagaaatttcatcgccttcttctctgcgcgcgttgattgctgagcgaaggaagtcggcatttgtcacaccgctgatttcacttgggtactgcatcgcaaggaataagcctgcctgcgcacgctcgtccacttccatctccagtacatctttgccgtcaagcgtgatgctgccttttgttacttcatatttaggatgccccataatagcagctgataaagtggatttaccagttccgttcgggcccattactgcgtggaattctccaccttttatttcaaggtttacaccctttaagatctctttcccttcgatttcaacgtgaagatctttgatcgttaatgttgaagcagccatatctatacctccaaaaatatataatcattattctcattttattctcattctaattttataacaaatgaaaagtaaatacaactttttatcgtgccttgcacattcctcaagtttaacaaagatcagcactttattaaagcgattgaaaaagaaaaagagtggattcccacccttttttaaaagattgattttctcaataagctcccgcagaaatccgcttgcttttttcgtaatcaagctctctctgccgctctactttcattcttgtttccagccggcgtccatattcctcgtatccaattccgtgtgacagctgcatcgctttttccatttctgacgtataatcgaggttcagtctgtcctggctactgcaaataatgaatcaatcccttcatatatttgctttttattgtaccagtgctgcgttggatgccgcaaaaacgatttggcgtgaaatagcggcagatgagacgaaagcatcctttcagaacaaatgagaatggtttttcggaatattccttctcttaatgcgtggtgtttccgaattcctcaatgcactgttgaacgactgtcacgccttggctgaaagctgcgccgcctccaaatgccgctgccacactgacggcttcgagaatgttttcttctgtcgctccctgatcgagacagccttttgtatgatagatcatgcaatattcgtcctgagcattgatggcaattccgagggcgatcagctgtttttctctttcagtcagagaattcccggcaaagcactgttcagtaaattcgttaaattttcttcccatcagcggcatcttttgttcaaatgtgcctaaaccatgtttatattgttttaacgcgtcctgcatgcttcctctgtcttgattcaaagaaaatccctccatctgtttaacattcctttttattatgaacagcttttaggaaaatacgcgaaaaaaccccggaattctcatccggggtttcagtcttattcagatacaggaagcacagctccgtcgtattttttctcgatgaagtctttgatctttttagagtgaagaacttccatcagcgctttgatttttgcagaatcttcttcgccttttcttactgcgatgatgttagcgtatgggttgtttttcgttgattctacttcaattgcgtcttttttaggatttaatttattttggatcgcatagtttacattgatgaagaccgcgtctccttctttgttttcatatgcttttgccgttaattcaggcgctactttttcgaattcaagatttttcgggtttttcttaatgtctttcaatgttgcgtcaactgtttccactttagaatcaagagtgattaatccagcgttttcaagcattgcaagcatacgtccttgttcagcaacgttgtttgtcagaatgattgtcgcaccgtctggaaggtctttcagtgatttgtatgttttagagtaaataccgaatggctctaagtgaacagcgccggcattcacaagtttgtaatctgtgttttctttcatttcttgctcaaggtaaggaatgtgctggaagtagttcgcgtccacttctttatcagctaaagctttattgtacattttgtaatcactaagcactttcactttcagcgtatagcctttttctttcagcaatggttcagcttcttttaaaatttctgcatgcggtgttttcgttgccgcaacgacaatttctttcttgccggattcagcgccgttattcgaaccgcaggcagccataactcctgcaaatacaagcagtaatgcacccaaaaatagctttttcaatgtaaatcctcccttatcgtttgtctataatatttgttattagatcaccgatgatttgaataataaacacgatgattaaaataaacacagtagcaacgaaggtaacatcagcgttattagactgatatccttctacgtacgcaaggtttccaaggcctcctgaaccaatggctccggcaattgccgttgagccgatcaaagcgatggctgtaaccgtaatgccagaaataagagcaggcattgattccggaatcagcactttgaaaataatcgtagacgttttcgcgcccattgatttagctgcttcaatcacacctttatccacctcacgcaacgcgatttcaacaaggcgcgcgtaaaatggtgccgagccgattaccagcgccggcaatgcggcgtttggccctaagatcgtgccgactaaaaatttcgtaaaacctaatagtaaaataattaaaataaggaacggaatcgatctgaatatgttaacaacggccgcaatcactgagttgaccgctttattctgccagaggcttcctttgctcgtcagaaagagcagcaagccgaggatgaccccgatgacaaaagcaaacagtaaagaaatcagcgtcatataaagtgtttcatatgtcgcgttccataattcagttaaatcaacgttcgggaagtatttttcaaacattcgtgatcacctctgctttcacctgtttgtcattaatgaaacggatcacgttttgcacttcttcctcgtccccgtcaatgtggatgaacagtgaaccgtaagccccatccttcgtctgcgaaattttcccttgcagaatattgacgctgacattgaagtttctgatcatctctgtaatcagaggctgttcagctgactcaccgacaaatgtgagctgaaccatttttcctgatgctgtatcatcaagaaggtgctgaagcgtctctttcgtttcttccggctctgtcacctgctgaacaaatcgttttgtcatttgttcctttggatttttaaagacatcgagaacctcgccttcttcgaccaccttgccgttttccatgacggcgactctgttgcagattttgcggatgacatgcatttcgtgcgtaatcagcacaatcgtcaaaccgagtctttcattaatatcggacaatagatccagaattgaatctgtcgtttgcggatctaatgctgatgtcgcttcgtcacaaaggagaaccttcggattgtttgcaagcgctctggcaattccgacacgctgcttctgaccgccgctcagctgggacggatatgatttttcttttccttctaaacctaccagtttaatcagttcattggcgcgcttgatccgctcgctctttttcaccccggcaatttctaaaggaaacatgatattatctctgacagtccgcgaccaaagcaaattgaaatgctggaaaatcatactgatctcatggcgtgcttttcttaaaccgcgtccatttacttcattaattttggttcccgccacttccacggttcctgaggttggtttctcaaggccgttcagcagacggattaaggaactcttaccagctccgctatatcctataattccaaaaatctcaccttttttaatggaaagcgagacattttggacagcattgacatctccatgtttcgacttgtaaacttttgaaacatcctgaagattgatcaaagcaatcacctgccttaacactattctaagaaatcttccggttttttctgcaaaagaaaagcctttctgcacacttgagcagaaaggcttatataaaatgcctttctctcatctttcaaagctgaacgcttcgtgtgaattggcaccatttcaacagtgttgatggttgccgggcttcatagggcacttccctccacctctcttgataagagaaatatatagtctttttcgtccggaaattcttaatgtagaatagcacggcgaatgattaaatgtcaataaaataaatgatgtcaacttttactattataataatttattattttttaattttttaaaatcctctgaaaaaatccatttgtcagccagagaatggcttccagctttaacagggccctgaatgacccctttactttgaggcttccgctctgaatcaggtgctgaagggaaatgtctccgtgcaataaatcaataatttccgtttggtttccgtaaaaggtcaggttggacgtttggggcggagaaacttttttcatttctccctgttcgtttattgagacggttaaggcttctgcttctccttggaaggtaatgagcaatgttgaggcattcaaaaggggttttaaaaacagatgctgatactcatcctctaaaacttccgctttctccatatgtacaacctcctatttgttggtcatacatacacatttctctctttgtcgcaagaacccctttataaaacgaacgacaatttcataggatatgctgagaaatatgtcataaatgggatgcggaagatgatttttgtttgatcagctcatataaataagaaacggaatgaaatgcatatcctctttcgaccatctttccgcctttaaacagcagaaaacaagggacgctttcaatttgatacgcttttgcgaatgtcggagagtaattgacattgttttgatagaaggcgacatccggcagcatttctttcaccactgtcagcattttgcttgcaagctggcaggtgccgcaaaacggagtatataaatatagaaggtacacatcatcttcaatgtgatcaagttcgtgttcttggagttctttcatgctatacacctcgggactttctttcaagaaaaatagtatggacattcagattcgcacgcagtaatacagaagcgacatggtgcctgggagcagccgctacttccttataggctctgtcgatatggagatggcaggcttcattaaattcacgcttcagctgttttctcaatttctcacctgattcatcagcatcaactaatatatagacgtctttatcataaagctcgtcagccaattcctcgagcctcagctggctgattgttccgtttgtgcagataatgcgcaccggttcattcaggacgctttcgattttctctttatctgatttcccctcgacaatcataaccttttccagctcatccatcttcatcttgttcacctgccgcgtcaaatttgaaacgttcagattgtaaaagaaggcagtgaaattcaccgccaacattaacaccagccgttttcgtagtcacaatctacatattttgcgtcgtctccagagaccacatcggctgtcttataaaatttctcattttcaaaggaataaccggacttaagctcatattcattcatgcttgtcatttggccgatcatctcattatcatgatataacgagagccggccattttgaaagcggcctgtcacgtcattggtgacatcgagcttttgtttgtcgaaagccatattggacacctcccataacgttagcgtgtccaattgcttttacggctatcctgttttagtcttcttgtgtcatctcttcgtattgctctgctgtcatcagtttttcaatttcagaagcgtcagatggctcaacgacgatcatccatgctttttcgtacggagattcgttgacgaattccggactgtcatcaagatcttcgtttacttccacaaccgttccgttaatcggtgcataaagctcagataccgttttaacggattcaacactgccgaatggctcgtccgctttgatttcagcgcccacttcaggaagttcgacaaacacgatgtcgcctagttcggactgggcaaaatgcgtaattccgattctggctttttctccttcaacttttacccactcgtgttctcctgagtaacgcaaatcttttggtatgctcaattgaatccctccattttttacagcactacaataagaagataccacacttttcaaaaaaaatttacattaagcccagttttcttcaaattggtcttctttaaatccgacagtcactttttcaccgtctgttgtaagcgggcgtttgatcagcataccatctgaagccagcagctcgagctgttcgtcctctgacatgtgatacagcttttccttgagattgagctcgcggtatttcatgccgctcgtgttgaaaaatttcttgagatccagcccgcttttttcataaagcgcttttaattcttctttgcttggcggctgctcagcaatatgtatttcgtttatttctttcccatgctcttcaagccacttctttgctttgcggcacgttccgcatttagggtaccagtaaaaagttaacgacatcttcttccccctcaataaaataatcgaggttattttaacacagtttgttttaaaaacctaaaacagtgcttcttaaaaaagagctccgcgcatgcggagctcatggccaatcagacagtatatttctcagcctcaaaaatgcctgccgccgcctcgcgttttttctgaatcacgtttttaggcgttacgcgtgtcagcttgcgcagagcggaaagcatcatgcggagtgaatctccttcttccattgcgataagggattccttcgcatgcgcttcaatttcgttaaaggcctcttgaacgaaaatttctgtgtacagcaccttttgcgctgctttttcagcgccttgtgcggcaatggccttttccgttctgagcacggctgattccattgcgtatacattgctgacgatatccgctacgttcacgagaatttcttgctcacgatcgatcgcttttccgtatttttgcgcggctaggccggcagcaaacaacgcaatttttttggcttgcttgacgatatatttctcctgctctaagacgccgcttccaggctcttcaggcataagcatcatgagttcttcctgcagcgactgcgctttttcgaataaaggcagctcgcctttaagcgcttttttcaggaaggtgcttggcacgattaaccggttgatttcgtttgtgccttcaaaaatccgattgatccttgaatccctataggccctttctacttcgtattcctgcataaagccgtagcctccatgaatctgcacgccttcatcaacgatataatcaagcgtttcagagccgaataccttattcagagagcattcgatggcgtattccgcaatcgatttggcgatttgccggccgtccttgagatcttcggccgtgaactggctcatattgtcttcaaacagcccgacggttctgtatacagagctttccatcgcatacagccttgaggccattgtcccgattttttcctgtgtcaatgaaaaaccagcaatcggcgttttaaattggcggcgctgatttgcatatgccgcagacagctcgatgacgcgtttagatgcgccgattgtgccaaccgccagtttgtaacggccgatgtttaaaatattaaaggcgatgacatgccctttgccgatttctccgagcaggttttcctttggcacttcagcttgatccagaatgagggttcttgtcgatgatcccttgattcccattttcttttcttccggtcccgtggagacacccgggaactctttttctacaataaaggctgaaaacttgtcgccgtctatcttggcgtaaaccacaaatacatcggcaaaagcagagttggtaatccactgtttttcccctgttaatacataatgggttcctgcttcattcagcacagctgttgtttttgctccaagtgcatcagatccagagccaggctcagtcagagcataagcggcgatcttttcgcctgaagcgagtccaggcaaatattttttcttttgttcttctgatccgaaaaagacgatcggcaaggaaccgataccgacatgcgcgccataagaaagagaaaagcttcccgcacgcgaaaatttctcagtgatgagtgccgagctgattttatctaggccgagcccgccgtattcttccggcacatcggcaccaagcagccctagttcgcccgctttcttcaacagtctgacagaatgctcgaattgatggttttcgatatcatctatatgagggagaacatcttgctcgatgtaatcctctgttgttttcgcaatcattttatgctcgtcagtgaaatcctccggtgtatacatttgatcgtatgtgacatcctcgattaaaaatccgccgcctttttgtacgtcagccgctttttttgccatttgtttttccccctttagcataattcaaatacaccggccgctcccattccgccgccgatacacatggtcacgactccaaattgctcgtttctccgtttcatttcatggatgagtgagagtgtaagctttgtgcccgtacagccaagcgggtgtccaagcgcgattgcgcccccgttgacattcactttttcttcatcaattcccaattccctgattacttgaatggcctgtgaggcaaaagcttcattcagttcaaacaagccgatgtcctgcagctgaagtccggcaagcttcaaagcgcgcggaatcgcttccaccggtccgattcccatgacttccggcggcacgccgcctactgcaaaggaacggaatttcacaagcggcgccaggccaagagcatcggctttttcccggtccatcagcatgacagccgccgctccgtcacttgtctgcgaggaattgcccgcagtcaccgtcccatcaacggaaaaggccgggcgcaatgtcgataagatgtctgcagtcgtttgcgggcgaacaccttcatcctgagaaaacacaaactgtttttccataggcttatggtcttctccgatttctgtcaccgtcacttctacgggtacaatttcatctttaaattttccttctgcaagggctttagcagcgttttggtggctgcgaacggcaaacgcgtcttgatcctcacgggagacgccgtattttttcgcgacttgctcggctgtgtggcccatgctcatataatattccggtgccttttctgccaaagcaaggttcggacgggtaacatgccccatcatcggaacttgcgacatggattctgctccgccggcgatcgctgtatcgtaggcgcccagcataattttttctgctgcatatgcaatagactgaaggcctgaagagcaataacggttaactgtaatcgccggaaccgtgtacggcaggcccgcgagcgcaccgatatttctcgccatattaagcccctgctccgcttcaggcgttgcacagccaataatcaaatcgtcaatattgccttcgtaaccgcctgcccgtttcagtgtctcttttacacaaatcgctcccaaatcatccgggcgaacggtggccaacgatcctttttttgcttttccaaccggtgttcttgcacctgacacaatgactgcctctttcataagctccctcctaattccgtaaaggtttacctttcacaagcatatgctgcattctcgcttgagattttgcctctcctgacaaactcaaaaacgcttctctttcgatctccaataaatactcttcatcaacctctgtaccaaacggcacttttccgcccgcaatgacataagcgagttttttcgcgatcttaaaatcatgctcagatatatagccggacagcttcatctgctcagcgccaagcaagagtgccgcataaccggtttctcccggcaccttgaccttttcttttacaggcggccgccagccggtatcgtataaagatgcggccagctgcttcgcatcgtataacaggtggtcttgattcacgctgatctgatccgtttcttttaagatgttcatctcacgagcctcttgagcggaagcggacactttcgccatcgcgattgtttcaaatgttttcattgccgcattcatcggatcatggccgcggcgaagatggttgatgtacagctctttgttacctcctccgccagggatgaggccgacaccggattccacaagtcccatataggcttcgcttgccgcttgaatgcgcgccgccggcaggcatgcttccgttcctccgccgagcgtcatgccaaatggcgcggcgacgaccggtttcgcactgtatttgatcttcatcatcgtctcctgaaaacggcggatcacaaaatcaacttccaaaaagttgtcatcttggacttccattaagatcatggcgagattcgcgccgacgcagaaatttttcccttggttgccgatgacaagccccttgtaattccgttctgtttcctctaatcctttgtggatcatttgaatgatatcgaggccgatcgcattgcttttcgaatgaaattcaagaagggccacatcatctccaaggtcaattaagcttgctccgctgtttttcgcaatcacgccttttgtttctttaagtgcttgtaaatgaattcgttttttattttctttcacggctctgtattcgccgcggtcataataaaataccgttccgttctctttgatgtagaaggtttcatttcctttgtccagcatctcttttatccagccaggcatatctgctccaagctgctcaagcttttccgctgactgcttgaggccgatggcgtcccacatctcaaaaggtcccagttcccagccgaatccccacttcatggcttggtcaatcgcatgaatatcatcggcaatctcgccaagcagctcggctgagtaaagcagggtttgagaagtgatattccacagcaaacggccggccctgtcatccgaataaataagcgctttcattttggcttttgtcccttttgcctgttttgccgcttcaagtgccggtgatttcatttttgtccgctcgccgtaagtaagcgtcactgggtcaagctcataaatcgtttttccttcttttttataaaagccttggccggccttgcttccgatccaccctttttccagcatatcgttcatgaagcttggaaggcgaaacacttctttttcatcgccatcagctttgtcatacacatttcgggcaacgtgggcgaatgtatcgaggccgaccacatcaagcgttctaaaggtggcgcttttcggcctgccgatcagcggtcctgtgatcgaatcaacctccccgacctgataaccgcctttcagcatttcttggactgtcacgagaagcccgtaagtcccgatgcggtttgcgataaagttcggtgtgtcctttgctgtaacaacgcctttcccgaggacattttctccgaaagctgtcataaactttaaaatatcaggatccgtttccttaatcggaatgatctctagcagctttaaatagcgtgcgggattaaaaaaatgcgttccgagaaaatgggctttaaaatcatccgaccggccttcagccatttcctgcactgatatgccggatgtgttgcttgagacgatgcttccagtctttcgatgttcatccacaagagcgaaaattttctttttgacttcaaggttttcgacaacgacctcaataatccaatctgcttctttcagtttttctgcatcatcctccagattgcccggtgtaatataggaggtatttttcgctgatgtgaggggagcgggcttttgtttcagcagttttttcaccgcctgccggctcagcctgctgcgcatctccggactgtccttcgtcagcccccttttttcctcttcctttgtcaaatcgttcggcacaatatctagcagcaggacaggaattccgatgttagccaaatgcgccgctatcccggaacccattacccccgatcctaaaacggctgccttccgaatgtgtttgtgcatgagatatcccccttgaacattgaatgaatagtcattcattttttgaccaaaaaaaatgaaacccgtttcttctttcatcttaaaagatttccggttcgacttcaatagctaatttgttatttttttgtatgaagcctataaaagtcgggcaacttaagcccggaggtgaagggaatggtacgagagaaaaaaaatccgtcttcagcggcagtcagcgcggcgagcgtaaagggagatgccggtccgactcagcattacggcggcggaaaactgacaagtcaaaatcagcagtataaaaaacataacatggaacaatcataatgcagctgcttcccgcggctgctttcactttttcaaaattccttttaacacaaacgctgcattggcaggccgctcggcaattcttctcataaagtagctgaaccagtccgttccatatgggacatacacacgcattctgtagccttccttggcgagttccttctgacgctccggcctgatgccgtatagcatttgaaactcaaattgcgacgcggggatttgatgttcggtgacaagctgtttcgtaaatgcaatgatgtcatcgtcatgtgtggcgacagccgtgtagttcccgcttaacaactgcagctttattaagctctgaaaatgaaggtccgttcctcttttgtcgggaaacgctacagccgcagattctttataagcgccttttacaagtctgagattcggctttaagtcccgcatctttctgatatcttctgccgcccggtacagatacgcctgaatgaccgtgccgagcttctcaaattcctgtttgcattgcctgtaaatagaaagtgtctgttcataatgagtatagtcttccatatcaatggtcacagcaacatcatattgcttcgcaacggaaagaatggcgcgcaaatgagtaagagcaagttcttctgaaagatcgagcccgattgaggtcagcttaagtgaaagctctgaattcaattgatgttcggcaatggcttgaatggctttcttgcattcctctgcgacttggtttgcttctttttccgaagctgcatactcgcctaaataatcaattgttgcacacaaaccggatctgtttagccttttgacggtcttaaccgccgattcaatcgtatcccctgcgacaaaccttcgtgctccaagccgcgttccgtatgcttttgcgaacttggtaagtgttttattttgagataagaataaaaacacatgtctcagcatccgactccctcccgccgtcatcttcaaaacacctgtatataactcccagtctgaaggaaactataaaatgaacagaaaccaaaggaggatcacaatggataatcagcagcaatctcaaatgccgccttccgttatttcgacaaaggatcatttgtatctcaatgacatgctgaactggaatttgctcgcgatgaagaaagcgcatttcatggcgcagcagtgccaggatcaaacgttaaagcaagaactcgaccgcgtcggacacatgcatcatgatcactatcaaagaatattaaagcacctgcagccaggccagcagcagtccggctacatccaataaggaggcgccagaatgaatcagcaaaatcaaaaaatcagcaacccgcagacacctgtaccgacaacatcggaaatgaatgacagagatttcgtcaacgaattgctgacaaccgaaaaatacatgacaacagcttattgcactgctttgcacgaattcagccacgagtctctttatcaggatattcaatccatttttgatgagtcacaaaaagcgcaaagaaaactatatgatctcatgtttcaatatggatggtattctgttgaagcggaggatgcacaaaagctgcagcagtcctatcaaaaattccagcagaccattcagcagcagtctccttatcagcaataacaacattagtaaaaaggatacgatgttctttagggcatctatcctttttttgtgtaaaatcagttgacttttcatttacgcttatttatatttaataagcattaactattttgtcattaaaatatatatacagtgtatgtaacagaggggaaatgaatatgaagagtgcggatcagttaatgtccgatattcaattatcgcttcaggcgctctttcaaaagatacagcctgaaatgctggaaagcatggagaaacaaggtgtcaccccagcacagctgtttgtgctggccagcctaaagaaacacggcagcctcaaaatttctgaaattgccgagcgtatggaggtgaagccaagcgcggtgacgctgatggcagatcgccttgaacaaaaaaatcttatcgccagaacacacaacacaaaagacaggcgagtgattgatctcagtcttactgacgaaggagacagaaagttcgaggaggttttggcaggcagaaaggccattatggcgcgctatctttcctttttgacgaaggaggagatgcggcaggcggcgcatattacagcaaagctcgcacaagcagcagaaacggatgaaaagcaaaacatgaaaagaggaaacggatgaaaatgagtaaagaaggcaaacaatcaaaacgaacgttattaataacaggcttaattattgccatgtttttttcagcccttgacggtaccattgtcggaacggccatgccgaaaattgtcggtgatctgggcggtttgagcatgatgacctggctgacaactgcatatttgttaacatcaacaaccattgttccaattgccggtaaactggctgatttattgggacgccgcattgtctatgtatcaggtttaattattttcatggctgcttctgctttgtgcggaatggccaacaacatgacagaattgattatcttccgtggactgcagggaatcggcggaggcatcatgatgccgatggcgatgattgttatcggtgacttgttcacaggaaaacagcgtgctaaattccaaggtgtctttggcgcgatttacgggctggcttcagtgattgggccgcaaatcggcggctggattgtagactcgttaaactggaaatgggttttctatattaacctgccagtcggaattattgcggttatttttattgccagaggattacagggacgccagcagactggtccgatcaacttcgatatcgctggtattttcacaatgattgtcggtgtggtcagcctcctgctcgccttaagctttggtggaaaagattatgcatgggattcatggcagattcttgggttgttcgctctcgcactgatcggcattgtcagctttatcatcgtagaatcaaaagcaaaagagccaatcctgccaatgtatttatttaaaaacagaacatttacatttctaaacttgatcggcttctttatgagtatcggtatgtttggcgccattacgtttgttcctttctttatgcagggaattgtcggtgtaagtgcgtctgaatcgggtacaattatgacaccgatgatgatttctatgattattacaagtatcatcggcggacagcttgtttataaaatcgggattaaaccgcaaatcattgcaggcatgctggttatggccggcggattcctgctgttaacgaccttggatctcgacacgagcaagcttgtcgctacatcttttatggcgattattggtctgggaatgggtcttgttatgccgattctgacattggctttacaggaaagcttttcgaaggaggagcttggagttgtcacttcatccagccaattcttccgttctatcggcggaacattcggcattaccatgctgggagccgtaatgaatgcgagatcaggaaatctattaacagataaattggttccatatttagactctcttccggcacaggcaagctcgtttgccgcccagctaaagggtatgattgatacaaatccgcaagggctgctgcaatcactgttcagtccggacgcggtcaaacaaatccctgcggctttctcatcccatattgtgccgattttaaaaacatcgttgatggattcgctccacagcgtgttttatacgggcctgatctttatcgcagtcggagccgtattcaccttgttcttaaaacctatcaagctatcaaataagaaagcggaagaccaacaagaaaaagagaaggcggcaaaagccgttgaatcaccttcccattaatagagcaccccgcgggtatcaatccgcggggttttttattcaatcatctgggctcttccatttccgaaagaccaatcctcagcctgatttccggccagcatgataaacacatcttcttttcttacaccaagctcggaatgaatccggctcgcgattgagcggtaaagtgcttttttctgttcagttgttcttgactgtttcagtgtaaaatgaatgtatatcagttcatcagtacgctcgacttggagataaaatggatcataaaaaaattcgcttttttcatattgtctgatgacttggaaatagtcatcttccggcacattgatttcttcaatcatcgattggtggatagtcctgctcagtttttgaagccacacttcgcttcttcccgaccgtaaatgaatctgtacaaatggcatctccccgcatccctttctttacagcgtctgtccgctgtcaattgtgataatttggcctgtgagtgattcctgttcaattagtgaacaaatcaatttggcaacatcatctggttcagcaatacactgcagcggcaaagagccgatcatgcttttcattttttcttcccgtccggcccaccatctcgttgccacagctcctggtgctacaccgctcactctgatttcaggcgctaaggcgtgggccaatgatttcgttaaaccgtgcaccgctgattttgatactgcgtaaggcatagatgagccgacaccagttatccctgcgatgctgccgacgtttacgatcgccccggccttgcttttcttcatgaacggtaccactgctctcgcgcaaaaaaacatccctttcacattgacggcatacagctcatcccagacgtcttctgtcgcagcctcaagatcatccattggaatatgccgtgtaatgcttgcattgttgactaaaatatcaaccgtgccgtgtgtgctcacgattgcttgaatcatatcctgcacgtcgctgtttttggatacatctgcttggatggcgaaggcttgcccgccagctttttgaatcttttccactgtttcctccgcttctgattgcgagcgtgaataattcaccgccacaatcgtcccgcgctttgccaattccatactggctgcttttccgattcctgtgccgccccccgttacgagagctattttgttcaagacattcattgccgccactccttgctgttgactaaagtatatttctgattccattgtaatccagctttgatgttacgtataatgattgttaaagatactagatatcactcagattgatagtaaacgaacggaggagttcaaaatggaaagcggagatttacgtgtgtttcaaatggtagctcgtgaagggagcattacgaaagcagccctgcagcttggctatgtacaatcgaatgtcacggccagaattcaacaattggaagctgagctgggtaccacactgtttttgcgccataatcggggcatgacactttctgcaagcggaaaattgctgctggactacgcaaataaaattataggccttcttgatgaagcgtctaaagcgctctcatcctccgcagaaccaagcgggccgcttatgatcggctccactcagacaaccgccgcggtaaggcttccaaagcttctggcatcttattatgaagaacatccaaacgtccagctgtctttaacaacaggacatacgcaatttctccttgataaagttcttcgttatgaattggatggcgcgtttatcggatgcgaatgccatcatcctgagctcgaatcctatcctgcgtttgaggaagaaccagtagttgtttcggctgcctccgtgcccgatgttgaggaagccatcacaaagccgattctcgtttacagcacaggctgttcgtatcgagaaacacttgaaaaatggctgcgctccgtcggtgtcacacagccggtcattatggaatttgggacgcttgaagcaattatcggcggggttacagcaggtcttggcatctcgttgctgccaagaacggttgtgcagaaacatgaagcagaaggatcaattcgattgtacccgctgcctgaagcgctcagccagatgaaaacagagtttattgttcgaaaagattcgtttatcagcagcgcgctgagaacctttatggattcctttacgccagataaaacggctgaatcacaaaaaagcagtctgctataatgtacagactgctttttggctattgtttgtttcgatgcgcttcatttaattccttaatatgctgaatgatctctttaatgccctgctttgcgtcggggtatgtcgcattccaatgcttagcgagcggtggcatgctcttggctatatgcgtgtacaaaatccattgcttcacttcttcttttagctcatcgtttgtctcaccaagcagaagctcagtatacttctccagcaatccatccagctgctcctgaagtttttgttccatttgccatcttcctttcgaaaaaacagcaaggagctttctcaattgaaagctccttcgctgcgttatttatccatgtgatgtgaaagccgcttcctggacaatgcatctgcccctgccatgaggaatgcaaagaggcgttccgaagagcgggtcctgtgtaacctgacagttcatagaaaacacattttgcacaagatcacaagtgatgacctcttccggacggccttctgcataaatccgtttatcttttatggccacaagatgatgcgcatagcggcacgccaagtttaagtcatggagaaccataacaatcgtccggccttccttttcattcagctcaaacagcaaatcaagaatttcaatttgatgcgtcatgtctaaatacgtcgtcggctcgtcaagaaggatgatatccgtttcctgggcaagcgtcatcgcaatccaagcccgctggcgctgtccgcctgacaaagaatcaacggcgcggtcagccatgtcctcaagctttgttgctttaagcgctctttcaactgcttcctcatcctcttttgaccactgcttcagccagttttggtaaggatatcttccttgcttcaccagctgatgcaccgtcagcccctcaggagccgaaggaccttggggcaggattgcgagctcttttgcgacttccttcgtcggaagcttggcaatcgctcttccttccagcagcactgaaccgcctctcggcttcatcaggcgcgctaatgaacgtaaaagtgtcgattttccgcagccattgctgccaataaatacggtaatttcacctttgggaattgttaaattcaactcatcaataataacggcatccccgtatcctaagctcagcgtttctgtagaaattgcactcatacccataaccgctcctttttgctggctttttagcagcactatgtattgcacgttttctatatacatgcttttaagtcaattatcatcaatgcaagtgattccgatattcagccatttgatatggtcatatatccctcattgtagcagaaaacactgactttgaaaatcattttcaattagttttatggacataattgacgtttatgggttttttatcacaagattacttcttgatttctctgatggagccgtccttcagcttcaattttaaatcgatatgatcataatgactgtccagattaaatgctgccagcacactgtgtatcacttctgtttcagccatttggtctgtcacggaaagctcgctcaaaatcattttcatctcatccaatgcttcttctccctcctgattgacaccggagagcttatcctgtatttccgctttttcctgagttccgttctttgtatagattccttcataacggttatgctcaccatccccgtagctcacacgaagcgaaaaattactgtagggaacggacttcagctgggtgacggctgtattttctccttctgcctgctgctggtcttcattgagacggcagcccgcaatcagaaccactgcgagacatacagccccggctgctctgaccaaatgcatatgtttcccccctgtaggattccatttattttaggtatatccagagaatgaaatcctcattcagagaagaattgaaaaagccggggcatttaacgccacggctttttctttaagattcggtcatttgtaaaaaggtttcggcgtcacgcacagccagcttgatggcattctcccagaaatcgcgctttgtgatgtcagcgcccaaatgcttcatcgccaaatcctccactgtcatagaagccgtatcgcgcaatagcgccatatacttctcttcgaatgtgtctttttcttcaagcgccaacgcgtaaataccaagagaaaacaggtagccgaatgtataagggaaattgtaaaacggcaccctcgtgatgtgaaaatgaagctttgatgcccaaaaaagcggatgatattcttctaacgcattgcagtatgcctctctttgcgcctcttccatcagctcattcaagcggctggccggtaccactccccgctttcgttcctcgtagaatctcgtttcaaatagaaatcttgcgtgaatgttcatgaagaacgcaacgcttctttgcactttatcctccagaagaacaagcttttcttccctcgtctcggcctgctggacagtcgcgtccgccactatcatctctgcaaacgttgaagctgtttctgcaacgttcatggcgtaggaacggtttaacggcctgacgttgagcattgcttcctgatggaacgcgtgcccgagttcatgcgcaagggtagagacatttgaggcgcttcccgaaaatgtcatgaaaatccgggattccccgctgtccggaaaactggtgcaaaagccgccgactctttttccgctcctgtcttccgcctcaatccagccgtcccgaaacgctttttcagtgaatgaggacagctttttgccaaacgttgaaaactggctggtaatgatatttgcggcttcatcatacgaatagacctttccgtcagaaccgatcggtgcctcgacatcgtaccagctgagtttttcaaggccgagcatggatgctttccggttcaaaaactgaacgaacggcttcttgttttcagtgatgacctgccacatcgtatcaagtgtttcttttttcatcctgttaatttgcagcggttccttcaggacattctcccagccgcgcgctttataggtttcaagccggaatcccgccaaatgattcagcgtgctgctgaaaatatcttgcttgctctcccaagcttggcggaaacgttcatatactgtttttctgacagtacggtcttgatgatccatcatattctccgcctgaccgacagacaattgcttgttttcaccgttttcctcatacgggatcgtcattttcccgacaaccatattgtataagtcactccaagcgtgatatccgtccaccgcaaggtttccgatcagtttttccttaccggggctaagcttttcggcaaccctctgtcttctttcatttaatatgtaagaaacatcgcgcaatcccggttttgttaacaattcattccacacgtcttgattaatgtccacaagtttatgatctaatgtaacgagcgacgattgaaaatctgcggaaagccgattcatgagtgcctgatgctctatagccttttgatcattgatattctgggcctggaggcaagcaacaaaagcgccggcctgctgaagcttgacggatgtctgttcgaataaatcaagcaacgcggtcagcccttcagcctcttcaggcgattcaggcacctgaaacgcatcagtcctgtcttgaaatgcacgcagactttgtgacagcttctcaatataacctttgaattcttccgattggctcccgcccttaaaaaatgaatcaagatcccatctttggcctaccccttgcagcgccatatcacaaaacccctttccttctttcgttctattatagaacaattctgaattattgtataaaaatttctattacaggcgtcatttcgtgttcaggatagtacaatagctgtagcagtttaataggagggttaggatgaataaaaaaatagccatcgtaacaggagcgtccagcggcttcggtctgctggcagctgtaaagcttgcccgatcatttttcgtgatagccacatcaagacagcctgaaaaagcggaacagcttcgagaattggctgcagcacacaatgtgtctgattctattcacattacagctctcgatgtcaccgatgaacaatctatagtctcattcggaaaagctgttagtgcttacgccccgatcgatttactcgttaacaacgccggaacggcttatggaggatttatcgaggatgtgccgatggaacatttcagacaacaatttgaaacgaatgtcttcggtgtgatccatgtgacaaaaaccgtgctgccttacataagaaagcatggcggcgcaaagattataaacgtgagcagcatcagcggactgacaggattcccagcgctgtcgccatatgtttcttccaagcatgcattggaaggtttttctgaaagcctgcgtatcgagctgcttccgttcggtatcgaaaccgctttgatcgagccgggctcatacaagacatcgatctggtcaacgtcattatcaaattttatgtcggtgcctgctgacgattcagcctatcatcaatactataaaaagatcctttcctatgttcaaaaaaacggagaagaaagcggagatccccaagaggttgccgacctcatttatcaattggcaacaaaacagcacataaagaatttgcgatacccgatcggaaagggcatcaagctcaccctgctgttccgatcgctttttccttggtctgcgtgggagtctatcctgaagaaaaagctattcagctgatctaaattataattattataatttagtattgatttttatttagtatatgatataattaagtcaacagatcacaaggaggacgttatcttatgaaaactgaaaacgcaaaaacaaatcaaacattagttgagaattcactgaacacacaattatcaaactggtttcttttatactctaagctccaccgtttccattggtatgtgaaagggcctcatttctttacattgcacgagaaatttgaagaactttatgaccatgcggctgaaacagtggataccatcgctgagcgcctgctggcgattggcggacagcctgttgccacagtgaaagaatacactgagcatgcatctatcacagacggcggaaacgaaacatcagcatcagaaatggtacaagcattggtaaacgactacaaacaaatcagcagcgaatctaaattcgtgatcggcctggctgaagaaaatcaagacaatgcgacagcggacttgtttgtcggattaattgaagaagttgaaaaacaagtgtggatgctttcctcttatttagggtaacaaaaaagctgaaccttaatcgggttcagctttttgttttttcttagcttgaactgctttctgtctgcttggtcagtgttgcgttcaacgttttcgtttttccctttcgcagcacttggattgttgttttatctccgacttttaagtctttgtaaaggatctgacggatatccgcactgctttccacgtctttaccgtttagtttgacaatgacatcctcagatttaatacctgctttttctgccggcgaatttgcttgaacttcttttacataaacacctttgcccaattgatctccaaacaggccgagcgtattttcctgataggtttcaggaacttgtgacatgtcaatcatctgcacgcctaaaaacggacggtccaccttcccgttttgcagcagctggtcaacaatcggctcgacatcattgcttgggatcgcaaatccaagtgattccacgccgctttcgctcaccttcaagctgttgatgccgatgacctggccgcttgcattgattaatgggcctccgctgttccccggattgatcgctgcatcagtttgcagcacgttcatttccaccgtcccttgtgttgtatccacatcaattgtccggttcaatccgctaatgatgccttgtgtcaccgtaccggaaaactgctgtccgagcgggttaccgatagcgattaccttttcgccagtgcgcagctgtgaagagtcaccaaagctcgccactttttttacattcttgccgctgatttccaaaactgccaaatcagtaatggtatcgctgccgacaagcttggcagtttccgtttctccgttgtatagcgtaacagtcagcttgttcgcgccttcaacgacatggttgtttgtaatgatatacgctttatcgctgtcttttttgaaaataacacctgacccggttccgctttcactttctgagctggagcctcctcccgtgccgaatgtgttattttgagaggtttggatatttgagattccgacaatcgtaggctctaaatcctctaccatatcagcgatgtttgatgcgttcgttatcggcgccgttgtaaaattatcagactgcacctgtttatttgcggaagcggattcggtcgcctgattttggtctgacggcagataaggcgcgatgccaagcatgaggcccccgccgataataccgcctaaaatcgggctcagccatgcggctctccgtttcttttcttttttcacagccgtttcttgcttttccatttctagtgcagaagccgtttcctgccgtcccgcttcatatgacacaggcgcgtcaagcaattcttgttcagaatgtccaatcagcttctggttttctgtattctgctgttctgtatgtgaaggttcagtttgatgttgatcgttttggccatcacgtcgataatccatgttcttacactcctttaacggttattcatttatcgttacatattcatcgcatgtacaagttcaattgtcccaataatgaggagaaaagcaaagcaccaaaatagaatatgtttgatcatcctacatcttcctcgctctttttctcttcctttcttcccttatacatatcataaacaaacattgtgggataaaaatgaaaagaatatgtgaaattatgaaaattgcctgccgtatgttaaaactagtttataatgacgttgaaaggatgtgaagagccttgtcatacaccatttatctagttgaagatgaggataacctgaatgaactgctgacgaagtatttagagaatgagggctggaacattacatcttttacgaaaggtgaagacgccagaaagaaaatgacaccgtctccccacctatggattctcgatatcatgctgccggataccgacggctatacattaataaaagaaatcaaggcgaaagatcctgacgtgccggtcatttttatttccgcccgagatgcggatattgacagagtgcttggcttagagcttggcagcaatgactacatttcaaagccgtttctgccgcgggagctgattatccgtgtgcaaaagctgctgcagctcgtatataaggaagctcctcctgtccaaaaaaatgaaattgccgtctcctcgtatcgggtcgctgaagacgcccgcgaggtctatgacgaaaacgggaatattatcaatttgacgtcaaaggaatttgatctgctgctattatttatccatcataaagggcatccatactctcgtgaggatatcctcctaaaagtgtggggacatgactacttcggaacagaccgggtcgttgatgatctcgtccggagactgcgcagaaagatgcctgaattgaaggtggagacgatttacggtttcggctacaggatgatgtcatcatgaaaaacaagccgctcgcgtttcagatatgggttgtcatatccggcatcctgttagcgatatcgattttactgcttgtgttattttcaaacacgctgcgagattttttcactaatgaaacgtatacgacgattgaaaatgagcagcatgtgctgacagagtaccgcctgccgggttcgattgaaaggcgctattacagcgaggaagcgacggcgccgacaactgtccgctccgtacagcacgtgctccttcctgaaaatgaagaggcttcttcagacaaggatttaagcattctgtcatcttcatttatccacaaggtgtacaagctggctgataagcaggaagctaagaagaaacgttacagcgccgacgtcaatggagagaaagtgttttttgtcattaaaaagggactttccgtcaatggacaatcagcgatgatgctctcttacgcgcttgattcttatcgggacgatttggcctataccttgttcaaacagcttctgtttattatagctgtcgtcattttattaagctggattccggctatttggcttgcaaagtatttatcaaggcctcttgtatcatttgaaaaacacgtcaaacggatttctgaacaggattgggatgacccagtaaaagtggatcggaaagatgaaatcggcaaattgggccataccatcgaagagatgcgccaaaagcttgtgcaaaaggatgaaacagaaagaactctattgcaaaatatctctcatgatttaaaaacgccggtcatggtcatcagaggctatacacaatcaattaaagacgggatttttcctaaaggagaccttgaaaacactgtagatgttattgaatgcgaagctcttaagctggagaaaaaaataaaggatttattatatttaacgaagctggattatttagcgaagcaaaaagtgcagcacgacatgttcagtattgtggaagtgacagaagaagtcatcgaacgattgaagtgggcgcggaaagaactatcgtgggaaattgatgtagaagaggatattttgatgccgggcgatccggagcaatggaacaaactcctcgaaaacattttggaaaatcaaatccgctatgctgagacaaaaatagaaatcagcatgaaacaagatgatcgaaatatcgtgatcaccattaaaaatgacggtccgcatattgaagatgagatgctctccagcctctatgagccttttaataaagggaagaaaggcgaattcggcattggtctaagcatcgtaaaacgaattttaactcttcataaggcatctatctcaattgaaaatgacaaaacgggtgtaacgtaccgcatagcagtgccaaaatagactgtagatgttttgcagtctatttttttatgtgaaagaatagccgttaaaatctctgtaatttgttttgagcggctgtttgcattgatgaacccattttttctctgacaaggtctgcttcggatatttgactttctccactttgattcctctgtttcgcaagcggctgatcatttcgtccaattctctcattctagattcaccctttcgcttgagctttgaccattcggtcatctcaatttataatataaataatacatgataaaaaaacaagttacaataaggttaattttataacagacggtgtgactatatggtcatatcctagcaggcctccgggctccgaaagggtggaaccattgaaggaaaaagaaaaactgattattgaaacagccttaaaactatttgcccaaaaaggatacaactcaacatcagtccaggaaatcgcaaaagaatgcaaaatatctaaaggcgctttttatatttattttccttcgaaagaagcgcttcttctctctatgctgaactactattatgataaaacgtttacccgaattttaaatattaaaacgaagggcgacagccccagaacggcttaccgtaaacagctgaccgtcctctatgaaaacattcttgaacacaaagattttatcagcatgcagttgaaggagggttctctgccttacacagaagaagtggagcaatgcgcaaaaaaaatccgccagtcctcacttcaatttcatatcgacagcctgctgaacatctatggaaaaaaagcggaaccctacactgctgagctttgttttttaatagagggcatcagccagatttacctggaatgcatgattttgctcgggtacactgtgaagccgtctcaattagctgatatcattatgaatcgaattgatgatatggtaaaaggcatgtctgaacgaaacgataagcctttcatcacattggaagaggcgagctctttattcgggcctcttacgcacggacggcctgacccgctgactgaatcaattgtgaaaagcctacgtgacaaaattaacagcttaaacacaaactcctctcttgaattatcggagagcttggacatacttgaagcagaaatgaagaaaaaaacaccgaagcttgcgatcataaaaggaatgattcataatctgacggagtctgaagctctcgccaaagatgcggaacagcttaaatatttattaaaacagcaacatatttagaagaacggctgcttaaaaagcagccgttctttcttcctattacgcctttggttttaccatgtcttccggcttaaccatttcgttaaattgctcctctgtcagcaattcaagcttcaaagctgcttctttgagcgtcaatccctctttatgggcaagcttggcgattttcgccgcgttttcataaccgatatgcgggttcagcgccgtaacaagcattaatgaatttgacaggttttcctgaatggtttctttattaggctcaataccgacagcacatttatcatggaatgaattcatgccgtcactgagcagctgcacagattgcaggaagttgtaaataataacaggcttaaacacgttcagttcaaagttcccctgacttgccgcaaagccgattgtcgcatcgttccccatgatttgcgctgcgatcattgttaacgcttcgctttgtgtcgggttgactttaccaggcataatagagcttcccggctcattttcaggaatgacgatctccccgatgccgcagcggggtccgcttgcgagccatctgacatcgttcgcgattttcattaagtcagccgcaagcgcttttaatgcgccatgcgcataagtgatttcgtcatggcttgtcagcgcgtggaatttattcggcgagctgctgaacgtttggccggtcagcttagtgatctcttctgagacaagctctccaaactctgggtgagcgttgatacccgttccgacagccgttccaccaattgcaagcgcacgcattttatctgtcgcttccaaaatcatttccttcgaacggtccagcatgtgaacccatccgctgatttcctgtccgagggtcagtggcgtagcatcctgaagatgcgtgcgtccgattttgacaatatcattgtatgcttttgctttttcatccagtgtattgcgaagctgatcaagcgccggcacaagctgctcgtaaacagccaaaacagcggcaacatgcatcgcagtcgggaatgtgtcgtttgagctttggcttcggttcacgtcatcatttggatgaatcgtttgatcagagttcttctcttttaataaagcagtcgcacggttggctaccacttcgttcatgttcatattgctttgtgtgccgcttccggtctgccatacgacaagcgggaagttgtcatcgtacttgcctttgagcacatcatcacaaaccgctgcaatcgcttctgctttttcagcgtccagattgccgaggcgtttattagctagagcagtgcttcgttttaaaattgcaaacgccttcacaacacgcatcggcattttttcagaaccgatcttaaagttctccttgcttcgctgtgtttgggcaccccaaaatttatcagcaggaacttttacttctcccatggtgtctcgttcaattctgtattccatttatgtatccctccataacggttgcttcaatagatcataattcgccaatgacacaaaaaatcctttttatttttcgatcttggcagattttaattttaattcaagatatacgcgggaatcctttgaatatttgtattttggatttgtcctgccgtactcctttgatgtataagagacatcataatgctgttcaaatgatctaatgagctgttcaatttcttcttgttttccagctagccttacctgtgccacttcgtatcctccgctttcataaaaaaacttactccatgaaatactctaacacagtatatcatttttttaacaggaaaagataacctctactaaggttttggataagaggtgacctcattggaacaaacagagtttaaggaatatatacacgataatttagcattggtgctgccaaaattaaaagaaaacgatgatctggtgaaaaacaaaaaaatgcttgcgaacggactggttttttactatctctatttcagtgaaatgactgatgagaataaggtgtcagaagccattaaaactttgattaaagatgaggagaccttaacgcttgaccaggtcaaaaaacgccttgaccagcttgacgcaagacctgttgaaactgcaaaaaaaacgattgaatcgattctcaacggcaattgtgctgtgtttatcaacggattggataaagcctatattctgaccacaggaaagaaaaaaacaagaagcctgacagagccgacaactgaaaaagtggttcgcggcccaaaagtagcgtttgtagaggatattgatacaaatctcgctctgatcagacaaagaacctctcatccgaaattgatcaccaaaaaaatcatgatcggcgaaaacaagctgaagcctgcagccattatgtacattgaaggcaaagcaaaaaagtccgtcataaaagaagtgaaggcgcggcttaaaaatatccagctggaagatatccaggacagcggaacgctcgaggagctcattgaagataataaatattcaccatttccgcagatacaaaatacggaaagacctgacaaagtatcttcagccctgtttaacggccgtgtggcaattttggtcgacagttcaccatttgtgctgctggtgccggtttctctcggcatcctgatgcaatccccggatgactactatgaacgctggatttcagcatctcttatccggtcgctgcgctttgcttctatctttatcaccttgtttttgtcatcgatttatatagcacttgtttccttccatcaggggctgctgccgaccgcactcgccgtcacgatttcggcgaacagggaaaacgtgccgttccctccgatatttgaagccctgctgatggaagtaaccatcgagctgctaagggaagccggactgcgactccccaatccgctcggacagacgatcggcctcgttgggggcgtagtcatcggacaggctgctgtagaagcgaatctcgtcagttcgattatggtcattgtcgtcagtgtcattgccctggcatcctttaccgttcctcaatacggaatgggtctgtctttccgggtgctgcgttttatttcgatgttttccgccgctattttagggctatacggcattattttatttatgcttgtcgtttatacgcacttaacgagacaaacgagctttgggtctccgtatttttcgccaaacggattctttagcctgaaaaatacggatgactccattatccgtctcccaattaaaaacaaaccaaaagaggtgaataatccaaatgagccaaaaacagactccactgaaacttaatacctttcaaggtatttctattgttgcaaatacaatgcttggggccggacttttaacattgccgcgagcgctgaccactaaggctaatacgcctgacggctggatcacgctgatattagaaggtttcatttttattttcttcatttatttaaacacgctcattcagaaaaaacatcaatacccttcactctttgaatatttgaaggaagggcttgggaaatggatcggcagcatcatcggccttttaatctgcggctatttcctcggcgtagccagcttcgagacacgggcaatggctgaaatggtgaagtttttcctgctggagagaaccccaattcaagtcattattttaacgtttatttgctgcggcatttatttaatggttgggggcttaagcgatgtgtcgcggctgtttcccttttatttaacggtaaccattattattttgctgattgtgttcgggatcagttttaaaatttttgatatcaataatttgcgtcctgttttaggcgaaggccttggacccattgcaaactcccttaccgtcgtttccatctcttttttaggaatggaagtgatgctgtttcttcctgaacatatgaagaaaaagaaatacacgttcagatatgcgtctctaggatttctgattccgattatcttatatatccttacgtatattatcgttgtcggagctttgaccgctcccgaggtgaaaacgctgatttggccgactatttctctctttcagtcctttgagcttaaaggcatatttattgaacggtttgaatcctttttactggtggtctggattatccagtttttcaccacatttgtcatttacggatactttgccgctaacgggctaaagaagacatttggattatcgactaaaacaagcatggtgattatcggcataacggtcttttatttttctctctggccggatgacgccaatcaagtcatgatgtatagcgattatcttggctatatttttgtctccctgtttctgcttccgttcattctctttttcattgtagctctcaagaggaggattacaacaaaatgaaaatccggattttatgtatgtttatatgcaccctattgctgtccggatgctgggacagtgagaatatcgaggaattaagcttagtgatcggagtagggctagacaagcctgacgatgaaaatttagagctgacacagcaaattctcgtgccgaaaataatcagcgccaaggagggctcttcatctgatccgacacagctttctatcacaaagggtaaaactgtccatcaaatgatgagaacctctgcattaaagcataagcctacgttttcacagcatttgcgtctcattctgctttccaaaagcgtgattgcggatcaaattggaatggacgccattattaaccagtttgtcagagacaacggaacaaggaggagttcctacgtctttatcaccaacggccgaactaaggatatatttaacatgaatgatgaaggcgaacccgcatccaacgtgatatatgatctgacagagaataataaggtgacgatcagaacgatggagccagttacattgggggagatctcagaacacttaacctctgacgattcattcctcatccctcatgtcggtaaggaaaacggcaagctcgcgataaacggagcctctatcataaaaaataaattatggcaccgggacctcaccccgattgaggttcaaaatatcagcttattttcaggcactgtcgagggaggcgtcattgacttgaagcgcgatggccatctcttttcttatgaagtatattcaagcaatcggaagatcaagacggcatacaaggacggaaagttcaaattcaccgtcacccgcaatattgaaggtcgtctatctgaggactggaatcccaatgaagactcgtttaaggattcatatattaaaagtattgaaaagacagtcgaaaaacgagtacacgaaacagtaacgtcatttattacagagaagctgcagaaagagatcaaagcggacgtaaccgggctgggaaacgaggtcagaattcattatcctcaaaagtggaaaaagatttcaagaaaatgggatgatgattatttcagcaatgcggaaatagactaccgggtcaatgtgattgtcagagacttcggaacgaaaggcgcaaacaaatagcagccgcctaattcacgagatgatttcggtgcgcgtacaccgccgcctgcgtccggtcactgacatccagctttgataaaatattcgtaatatgtgttttgactgttttaatcgtaataaacagttcctcgcctatttctttgtttgtctttccttctgcgatcaggcagagtatttcgagctcccgttttgtaagcgattcatgcgggagcgcgttttcacctgagtggcgcagcctggataatacttttcccgccacttttgactccagcttcggctctcccttgcttgcggcgcggatggcatcggcgatttctgccgcttttgaggttttcaacagatagctgagcgcgccagcttcaataaccgggtacactttgtcatcatcaatgaagctagtgagcacaataattttcgggtcggaaagctcccggcaaatttgctttgtagcttcaatgccatccatgccctccatgacaaggtccattaaaatgacatcaggcgacagttccacagcaagccgaacaccttcgctgccgtccgatgcttcgccgatgacttcaatatcgggctgcgcctccaaaaaagccgcgagccccattctgaccatttcatgatcatcaatcaataatactcgaatcacgttcgttctctcctttttcttccggaaaaatcgggaccttcacttcgatttgagtgccttttccttctactgaaatcacttcggcgacaccgccgatttcacttgcacgttctttcatagaattcaagccgtatgaggaggctttcacctggtccattttaaagccttttccattatcaatcaccttcagacggagctggctgttctttatgcccagaatcacggttacttttgacgcttttgaatgtctaaatacgtttgaaagggcctcctgcacgattctgaacaagtggtcttcaacacccttggatatcgctgtgtcctgtatatcccactcaatatcaatcggctgcttttttcggaactcgtccaaaagctccgtaaggccctccttcagcccttttccttcaagggtaacaggccgtaaatggagcagcagcgccctcatctcattttgggcttcgcctgccatatgctcgaccatcttgatccgcttgactgttttgtcatcagcatccttgacatgttccagcacggctgatgtcatcatcgatatggcaaagagctgctggctgaccgcatcatgaagatctctagccaatcgctggcgttcttctgagataaccgacttcttcatttgagcctgccattccgcacgttcattggaaagtttctgcagggatgcgacttgaagctccacgcgcttcgccatttcgttcagctgatcagcggccaggccgatttcatcatcaccgagcggaggtatccgataagcgaaattgccgttttcaaaggttaaaatggattcaattaatgtatcaatccttgtcttcaaccggttgccgtacatataccctgaggcgaaaccgactgtcacgctgatcagaagcaaaatcaggataaacggaattccgaaccagcttgatgacagcaaaacaagcggatcgagccgatagtaaaacatcataaaggaaatcaggcaggcaaaaaggagcaggctgattcccgttgtcatgcggatggcgcgccattggaggctggcaagcattttttttctcatacgtacttcacatccacatcaccgataaataaggaaacggacacttttacccggcgctttgactcgctgaaatcagttgacgcggcatataccttcgtgcttaatccgcttttcttcgagccgatcagattaatgtcacctataaaaacagctgagctgacagccacttcaaggtccgatggtacataaatatcaacgttaccaatgactccgctaatgacgattgtactttctccctcgggaatcattgctttagataaatcgattttgatatcaccgataaaaccagagacatttaaatcattcaggtcaaacggctgcttcatcatttgcagctcaccgataaaaaagctgcgcatgtcgggatgttttacatcttttggcggatcatgatgttcttttttattgagattgacctgtttctcattcggttcaaatatcggcttccctttgataagcctgtagccggcgtaaatcagaaatgcggcaaacgcatagccgaataaattaaaggtgatgctgaagaggtttttcaaaaatagaaacgcggcaaagatatacatgacggagccaagccaatcacgggaatattttttaaggaaatagccggcaatcagaaaaaagagcggccaaaacagcagatcgcctattccgataatttgcaaaaacatactgatgccgaataaagcaatgatcaatccgagaagctgtttttttgtcattcctggtgtccgcctcctttcttctgcctagtgctaccgtatcgctagatccccgctgtccgttttgatgtcgattggatgctggccgcttccttgcgtgcctgtgatgtgatgctgttctttatgtgctttatcagcaaatgaatacggcgaactgacgtcaccgcttgctgataaagcattgactgcaaagctgccgttttggggaaggcttacattagcatcaccgcttgtcagcgtgacagatacgggaccggttacctttttcaatacagcattaaaatctcctgaagtcattttcacatcaagagagcctgatacatgaaccagatttgcgtcccctgaagctaaatcaatgccggctgttttggagacggtatttgaaatggaaacatcccccgatgatgccttcactttcagatcttgaatgcggacgtccgtcacgctcgtatttccgctcgcagatactgcgttcagcccggaaagcgcaagatggtcattcccggccacagacacgtcaccgcttgaggttcgtactgccagatcacctttataatcatacggaagcctgacgataagagttgaacggttaaatccattcaaaaattgaaattctttttcctttacggtcagctccagttttcttctgttttcagtaacaaataactttcctgagtctcctgaaatgcctgccgatatgtcacttcgttcttccgctataatccggacatccttgctatccgactcaatgaccatgctgtcaatgtcccgcggcgatgcgctggctgaatcagcttctgtgccatttatgaaacccaggcctgcagcaaacacatcttttacgacaacagcgaaaaaaaccagaataccggcagtgatcaacagtttgccaagcatttttttcattcggtttcatccttctcattcattctattataaaggaaaagcttgcgaattgatacgtgcggaaggggaaggacttgaccgcaaatccttccccgttccgcttattcatttgccgcttgtgtctggtctgatttttgcagtgaaagtgtccgcattttttcaatctccgcttctacatcgtctgcgaattctttacgtgtaagttctgtgccggcttccgctgactttgaataattcgcgcggatttccatttcttcaatacgattttcaatacgcaaaaattcacgatacgcgctttcactgtcaattttgtcaaatgtggtattcatatgctctttagctttcgccgcatttgcccgcgcaatcagcgcctgttttttatcctttacgtcctgaagctttgtttcaagtgcagccagttgctctttcagatcggccagctgactgtttgcctgttcataggaagctttatgctcagccgcctttccttctaaatacttcatttcagtcagcgcctttttcgccagttcttcttcacctgcgtcaaatgcgagctgtgcctgatttttccgttttccagccacttcagcggcttcttcatattttttcttaaattgataggcaatggtgtgctgtttcacaattgtttgctttgcttttgcgatgtcgctttccatatcgcgtacatattgattcagcatcacctttggattctccattttatcaagtccttcatgaactgacgcaacaaacatatctctgattctttttaataccatacctaattcctcctaatatattgatattattttttcttcaaaaattcttcccattcatcatcaaagtgagattggtaggcagcagaagccggttcaggatcaaaagatgatacaccgttatcagctgatccgtttttcatcagcttccagccgtaatacaccatagcggccgccaatgcgattccgacgacaaacggaagtgagcagatgagcataatggctccgataccgcccacgatgattcccgtgatggtttttcccgcggcaaaccttttgactcctgcgtatgtcatcaagctcccgatggcgagcgggatgataaagccgaagcttcctcctccaaaaaagacggatatcccaaatacaattaataagaatccgcctatagttttcttgttgatcttcatgcagatcctcctttcgttttccttgtcttcatcttatacaagttagaagatatgcaaaacgaatcagagattgatttttatataagaccggagtcgtatctcggacaggacccatcggcacaaaaaaacgccatgcacgaggcatggcgttttaaaaccctttacagatgaacacttgcttccctttctttaatcaggtcggacctttctgctttggccagttttgtaaacagcaagattccgatacccgcaataatttcgacaatcccgccggcagcaatcactgttcctgagccgaaagcattagcggcatacccgcaaatgacagctccggcagggatcgaaatatttgagatcatatgtataacggcgtaaacctgcggctgatcctcactatccacagacgtctggataatcgtgtactcaggaacattaacagcactgactgcggcaccaaaggtaaaagcagcgaaaaagacgagcggcaaaaaggtattcatccctgtaataaagaaagcaaatccttcaataatgccggcagtgacgaataacaagccgtacctgtttaccttgactttcgccagcacaaaccctaataaaaacgcgcccgcggcggtggtggcctttaaaagcgagtatacgatcggctggccgtttaaatcttccgcaacgtatacggcagagagcgcttcccatggggcagccgcgaaattcataaagatacagtaaatggcgagcggatataaaatctggtgttttctgacgagcctaaagccgcgtttcagtcttccgatatatgtgcctctctgtgtaacaaccgcagactctgattgagattcaaccgcagtgtacttaataaaaagaacgagaaaacctgacaccaaatagagcacaagtgcgataagcatggtataagaaggactaataaatgtaagaaaagcgccgcataatgtgacagccccaagccggacaatttgagcggaggattgcagcacagcgtttgctttttgaatgccctgttcattgacgatttgaggaatcaaagcgatagaggcgggattgtaggcagctccagtagctgaatgcacaatcataagcgtcatgacaaaccacagcggagagaagcccgcaaaatgacatagagggataatcaaaacaatcgccgcccttgtcagatctgaaaagtacatccaaaatttcagcgtggtctgtttcataaaaggccccgtcacaggcgccagaacggcttccggcaaaaacgtgacagcaatcaataaagcagtgccgatcgcacctttgccgtcataaattaaaaaccataatattgaattaaatgcgaacatatcgccggatatcttgactattcttgagaaaaacagataattgaaatttctcttccagatgctatcactttcaattaaattcaccatccatcagagccccccgttgcctattttttacatctatttattacaatatctcatttttccatttttcagtcaataattcataaggttcattttttgtcgtaaaatgggaaattgacagagtgaaaaacaaaaaaagccggcatgtatttgaacacgccggcttccttttcactttttatgattcgctgctgtttcggtcccgaaacacaatggcacttctttcatattctacatcgccaataccgcttcttgcattcacaacccgtgcggcggcaaagaaataatcggacagacgattgagataacgcagcactgtttcatgaatctcctccgatttcatcagcgccaccactcttcgttctgccctccttgtaatggtgcgggcgatatggagaagcgaagcacctcttgatccgcctggaagaataaatttcttcagttccggcgcttctgctgtataggcatcaatgcgcgtttctaaaaaggaaacagattcttccgttagtttgtagtcttttctttctgtgacgattgccagatcgcctccgcagtcaaacagctcatgctggatggtcagcagctcggctgtcagatcttcaaagccgggctgcccggaaagctctgccaaagcaagcccgataaagctgttaagctcgtcaatcgtgccgtagctttcgacgcgtaggctgtccttgtccgttctgcccccgactaagcccgtttgtcccttatcgcctgtttttgtatatagtttcataccctgaatctcctttacagacttattcaaacaactcagcagcctcttttacacattcagctgtccctttctttatcaattgattcagccgctgttctatgttttcggattgctgagtttgagtcgcggcgatgagaatatcacctgtgcctcctccgtctcccagcactttcgtccgttctgcttcggcagccataagagctttgatgaagaattgatctgccgcatagccgtttatcaaaatccaaatcgaaaagccggtctgaacgcatatgaaaacggataactctctgtcttcatacgttcgatacacgaaacggtcaagtctttctgaagaagccatcgcacacgtctcctgcagttgaaaaccgctttctgaaagacaggccgtaagtccttctatcggatctggctgatctggcagccgtttatggatcagcgtcctgctccacgaaaaccctgcaccgataggcgtcgaggacaatgttcgaagcgggatttccgtttgcagaagaatgtcatcacgccccgcttggagcaatgcttcaaatgggatagactgccgcttcacgctatctttttcaggctgaatcacaatcatcggtttaggtgagctttgatgaaccaaggcggtgacatctgtatcgtacaccgcctttatgctttgttctgtaacagcatattccggtttttgcttaggcccggcggtaccgtttttcataaacatgagcccatcacagtacaggcttgcggtgttcagatcatgaaaaacgctgacagctgccaatccgctttctctcgtcaggcgtttgatcagatcaagcaggtctttttgataagccagatcgagaaaattagtcggctcgtccaaaaataaaatacgcggctgctgcgccaaagcttgtgccaaatacacccgctgctgttcccctccgcttagttcgcgaatcggcttttgcgcaaaatcggccactcctgtttgctccattgcttcctgtacaatggcttcacccttttcagtctgctgtctgaacagccccgtttggaatggatatctgccaaaggctacagtttcttcgacagtaaaggtgaaggcttgatccattttttgcggcaggacagccatgatttgcgccagttccttcggtttatagtccgccagcagttttccggccagataaaccctgcctttcttggccggcagcgtacctgtcagcaagtgcaaaagcgtggtttttccgcttccattagggccgagaattccaagaaattctcccttctccactgttaagctgacattgttgattaggcggctgtcgccgtatcctcccgacagcccttctgccttcatcataagcttctccccccgcgatgctgccgaattaaaataagagcgaacacaggcgctcccgccaaggacgtaatgatcccgatcggcagttcaatcggctcaatgatggttctggaaagcagatcggctaaaacaagaaaccctgccccaagcaaggcggacaacggcagtaaatgccgatggtccgttccccacaaaagccttgtgatatgcggaatcacaaggccgacaaagccaatcgtacccgatactgccacagcgcttcccgtcaaaagagatccggctattaaaatcatcatcttcctctgctgaacgctgactccaagaagctttgctttatcttctccatatgtcatcacgttcagttcccttccgtttataatcaataaaatggttcccaaaagaaaaaacgggagaaacaaaataacatagctccagcccctcattgagacgctgccaagcagccaatgcacaatcggaagcaggttgtctcctgtcaaggcgatgataagagaaataaatgcgcctaaaaaagagttggtgatgacaccggtcaaaatgagggtggaaacagacatcgaagcatgaacgaggcggctgaagaaaaggaccgccgccatcgtggccagtgccgcggctacactcaaaaccgggagtgtaaaccctccgatgacaggaaggtgcaaacctaagaacagagtcacaacagctccgactgaagcaccggatgacacacctagcgtatagggatcagcaagcggatttttcaacaatccttgaaaagcggcccctgcaatagaaagagccgcccccacaagggcggccagcacaactctcggcagtctgatattcatcataatattagtgtacatcggatcatcagaaccgatagagccgccgaaaccttgatgccaaaagacacgaaaaacagcgggaataggaatatgcaggctgccgcaagaaattcctaagatgatgctcacggctaaaaatgagaaaccaatgatatatgcggcataacgattattccttaaacgtatccgggtaaatgctttccgcaagttcttcgaccccttcgatcagacggggaccggaacgtgtcacaagatcagggtccacatcatatacacgatgatgtttcacagcattgatttcgctccagccatcgcgtttttccacagctttcgctttcacaccgtccgttgtaacaattgcatcaggattgagttttacgatcgcctcgtctgtcatttgcacccatcctgtctgatccgcagctgcgtttttagcatggatgacatttagcatttcattcataaacgtatcttttccggttgtataaatgtcaggatcaggagaaacctcgataaatacgcttttctcctcgtcttttgaaatggttttcgctttttcttgaatatcctttagatctgatttcatgcttttcacgagctgatcggcttttttctccgccccgccagcttctccgatcatttcgattgatttgtacacctcggagaatgattgtgcatcattgacagtcagcactgtaatgcccgcgtccttcagctgtttgatggcatccgctgatgctgacatggaagactcatgggccagaacgagatctggttttagagaaatgactttttcaacgtttacattcatatctccgactttctcaacctttttgacttcctttggataggtatcgtttgtggtgacaccgaccactttgtcaccaaggccgagtgcgtatgtaatttctgtgttgctcggcattaatgaaacaatcttttttggctcttttttgatggttacatcttggtttgacgcatcatcaatggtgacagggaacacttctgttttttgttttgcctttgaatccttctgatccgcaggattgccgcagcctgccagcataacagcagccaacagaagcgcagcccatatcccggctcgttttttcataatcttttcctcctaaacgaactaaaaaagcatctctacgacggtaaagatgctgtaaacaacacaaaaaagcctattgtttacacatcatctgtcctcgcagaattcgtgctgatcaaacaggcaggtatcctggctcttggcgcttggccaattacagtggcgggaccgcaccggcttttaccggtttcccttttaagccggctgttgttcacggaccggcacctatttgacattcgtatccgtttttcggagtaattatactatatgactgacaggcttgtatatgtgtcctgaatgacttttccccatattgtgtatggaagcaaaatcctcgtaaacactaaatttgatcttgtatacttaataccatcatctatcaaaaggaatgattcttatggatttacagctaaaagaaaaactcgtcttaatcaccggctcgacgtccggtatcgggaaagccgccgcaaaaagctttctgcaagagggtgcggcagtcattgtcaacggacgcaaacaggagactgtcgatcgcaccattgaagagctttctggctatggaacagtgcacggtgctgctgccgatttgtcaaaaacagatgaagcagcggcttttatcgaaaaagtaaatgaaatcggtgatatcgatatccttgtcaacaaccttggtttcttcgaggtaaaagacttcgccgatgtgacagatgaagagtggaatcaatatttcgaagtgaacgtgatgagcgccgttcggacaagccgtcacttccttccaaaaatgcttgccaaaaacagcggccgcattttaaatattgcaagtgaagcaggcgtcaaaccgctgccaacgatgattccatactcaatgacaaaaacggcactgatcagcctttcaagaggaatggctgaaatgacaaaaggcacaaatgtgacggtcaactcagtgctcccgggacctacttggacagagggcgtggcctcctatatggaaggcgccgcacaagcagccggacaggatacagatacatttatcaaagactatttcaaggtcaatgagccaacctcacttattcagcgatacgcgacagcagaagaagtcgccaacacaatcgtattcctcgcgtctgacgccgcatccgccattaacggcacggcacagcgtgtggaaggcggcattatccgttctctgtagtataaaaaacgcatccgttgtttcggatgcgttttttttatacgtctccagcaaatggtaccggctgatatccgcctgtttccagttgtgctgaaaacaaccctccagcgtgaggctgctcgtatctctctttttctgtcatttgttctgttgccgttgtaatgtaaagggtttttaagtctttgccgccgaacgcgcagcacgtgacatatttagccggcacgctgattgaattgatttcttttttctgaaacgggtcaatgtgaacaacgcggctgccgccaaacagcgccacccacagcatgccattttggtcaattgtcatgccgtccggcaatccgtccgactgatcaaaacgatagacaggttctggattcgaaacatccccgctttgaggatcatagctgtaacgtacaatctcctgggtcggcgtgtcgatgtaatacatcaaattccgctcgcggtcccaatccaaaccgtttgaggtggagacttgatccttgattttgacaagactgccgtctagattcaaacggtacagcgacgcctgtttttgctcgccttccatgctcgtcgtccccgcccaaagccttccgtacgggtcacatttagcatcattaaatctcaggctctcatgcatgtccttcggctgtttaattttttccaagctgtcatcccgaagatgatacaggtaaaacccgtccttcatcgtcataatcagttcatcctttgaatatttcgcaagcgccgtcacaaaggatttgaatttgattgatcggttgattttttcttcagggtcaaagatgtggagctcgctccccaggatatcaacccaatataagcggccgttttcttcatcccataacgggccttctccaatcactgcccgagtgtctgcttccaatactgcatccatgtgttacacctctttagcttcagtctatatattgttattcccggcaaagaggtgtccaaaccacttgatgtttattgttttttaaaaaggatggtaatgaccgttccaatgttcattctgctgttcacatggatcgttccgttatgcagatggacaagctccttggcaatcgcgagcccgagacccgttccggcagttgaatcttttgtgttcgtccctctgtagtaacggttaaacaaatgggtaatcgtttcttcatccattcctttcccattgtccttcacctttaaagatatatgattttttgtttgctccagaatgacttgaatctctgttcctttgtcgttgtgcttcacggcattcccaaggaggttttctaatatgcgcctgaaccacgcttcatcaagggcaaattcaatatgctcttctttggatacaaacgagatatcatagccttcagaaaacggatttttcttaaaatcctcaatgacatttttaaaaaacgggataaggctagtgagatttctctcaataggaagagcatcatttttcagccgatacgttaaatttaagtcttcaatcagcttagacatgtattcagatttttctctgacaacctgccccatttctttcacttcttccggcgaccagtcatactgcttcgactcgagcatcatgctgtagccgtaaatgctgctgagcggtgtttttaagtcatgtgacaaaccggcaatccattcttcccttgtcgcctggattttttctctgtttcttttatcccttctcagcgtttcagtcagctgatccattgattcaaatatctcaccgaagaagcggtacggctgtttgatttttccctttttatttttgctgacaggacggccttcccggtttctaggttcctcaagcttcccttttgacagattgaccagccatctaatcgtgtgaaaaatcggcagcccgaatcggaacatataccaaacggtcatccaaatgatatacatgaacaaaacggccatcacgagaaacatcgcttttaatacaaccttcaggaatgatttgttaaactcctgatcggttacatagactgggtttggcaccgtagcgaccatccatctgtctttattgaggatcttaacggaaatttcccgcttatagttccaaggcttagagctgtatttaagcagctccagctggttcatcgtttttctttcgctttttgtgctattgatgctgtcgagaatctttccattgctgtctaacaggtaaatggcgccttttttccgtttaatatagtcgatggtactagacttatagtgcgctagtgagtctatcttttgttcacgcttttcaacggaagtcaggagctgttcactttttgatttccagccggacaatagaagatacgacttatcttcaatattgatggcccaataattcagtttatagttatgaagctttttggttttataaatagacaaaagctctttcttggtataggtgcccggcacgtcttttggcacgccgtaggaataatcagtgtttccttccgaatcaatgatttgcatccagccgtgctgtttatcaacagatttcttcaggaaattatccacttcccatgtcccgtcttcgtttacatcgagatatgcctcaagtgtgtcggtcgttgctttcgtcagccctgaattggattccgcatcgctaaaacgggcgtctaaatagaaaaacgatgcaacaagcataaccgtaagcagcaggatcacaatcagcatctggccgaaaaagtgaaacaaaaacttccatcttaacctcatgaccgcttgccttcaggatttgggataaaacgatagccgagacctcgaacggttacaatatactccggattgctcggatcgcgctcaatcttctccctaagcttgcgaatatgaaccatgacggtgttgttgtcaccgtaggaaggatagccccatactttttcatatatttgatctttggaaagcaccacgttagggtgttcacaaaaatactgcaaaagctgcagaagctgggctgaacaggcaacggcttccccgcctacgatcaactcggcattttgcggagaaaaagtaaagtaatcatatgtgtaggtttgatttgaactcgtttctttcgattgatatgtacgcttgagatgcgctctgatccgcgccgctaattccagcggattaaatggttttgtgatatagtcatcagctccaaccgcaaagcccgataatttgtccgcgtcggatgatcttgccgtcaggaaaaaaatcggagcgtctgaatactctctgatcaatgtgcaggcttcaaaaccggacattccgcccatcatgacatccagcacaatcaagtcaaccttattggccttcacaacgggaatcgcttcttctgcgcttgccgcatccagtatatttcgataaccttctttttcgagaacgcgtttgatcatgtccacaatcgctttctcatcgtctacgattaaaattgacgcattttccacttttatgttcctttctgtcactgtttttttcatcttatcattatatcgtttatttatggtacatttttgaatacattggagcttggcaaatcaaaacagcaaaaaaggagcaaacaagcgctcccttttgatgttttttcatatgaaaatattatgagttctcatctaccatgtacaaaataaactcccaaaaccccggtacatcctgacataaaagcatatcagccttttcaaacattttgatcttcagctcttgctctaaatcttctctttcttgataggacgtattgctgagtttttttctgatcatcggtgaaaagcatgcaatcaggtgctcaatgtcataagtctcgtctttttgtttctttttttgttcaaactggccgtccacagcttacttttccccctttttttgcgccgctaactgctttctgatattctccagcccctttttatgaatgttggagatgttttgtcgggactcccctaatgaatctgcaatctcctgcatcgtggcaccgtgaagatagactttcgtcagcacacttttttgtttgtcagtcagcttctggatcgcttggtagagctggtaatcctgtacatgctggctcaaatcatcctgcctgtctaaaaattcttcaaatgcatcgctacctgtttcggaaggaagccgatctcccgcctccggatgatcaaccgtcagcggataccgtttttggtttttgcgaacccgcttatcaaaatcaatagaaaagatgcgaatcattgaattcatatacttgacgatgcggatttctttataaaattgcttaaatagctcgtccaatgatcttgcatctttttcgttagggctttccattacgtttttgaacaaacggtaatgctgaggattgctcaaaaaatgcttcacgatgggatgcttcattatctccttacattttgaccgtaaaagactttgatagtccatcaaaccgcctccctactaaattaaatgaaggaaagcaaaaaaaagtaaactactactttccgcctagtgtcttccaaaatactttgcagcagtttacgttttatcggttttcctcacttacatacatgactgcagaaaaagaagggaggtattttcctatggatcaggtttttatagaggaagtcgtaaaacagatcggcaatttggggtttcccgcgctgattgcaatgtatctgctgacccgattcgaaaagaagtttgatcaactaatagaactaatgacagaaatgaaagatcatgcaaaaaaataatttttcaatcgaagttgacttttcactggtttttttcacttaacaaaacagaagggaaaacgaaaggcctttcaccttctctttctgctatcacatttaaatgtaaggaggaaacatttcatgaaaaaacaaaatgacattccgcagccaattagaggagacaaaggagcaacggtaaaaatcccgcgcaatattgaaagagaccggcaaaaccctgatatgctcgttccgcctgaaaccgatcatggcaccgtcagcaatatgaagttttcgttctctgatactcataaccgattagaaaaaggcggatatgcccgtgaagtgacagtacgtgaattgccgatttcagaaaaccttgcatccgtaaatatgcggctgaagccaggcgccattcgcgagcttcactggcataaagaagcagaatgggcttatatgatttacggaagtgcaagagtcacaattgtagatgaaaaagggcgcagctttattgacgatgtaggtgaaggagacctttggtacttcccgtcaggcttgccgcactccatccaagcgctggatgagggagctgagttcctgctagtgtttgacgatggatcattctctgaaaacagcacgttccagctgacagattggctggcccacactccaaaagaagtcattgctgcgaacttcggcgtgacaaaagaagagatttccaatttgcctggcaaagaaaaatatatatttgaaaaccaacttcctggcagtttaaaagatgatattgtggaagggccgaatggcgaagtgccttatccatttacttaccgccttcttgaacaagagccgatcgaatctgagggaggaaaagtatacattgcagattcgacaaacttcaaagtgtctaaaaccatcgcatcagcgctcgtaacagtagaacccggcgccatgagagaactgcactggcacccgaatacccacgaatggcaatactacatctccggtaaagctagaatgaccgtttttgcatctgacggccatgccagaacgtttaattaccaagccggtgatgtcggatatgtaccatttgcaatgggtcattacgttgaaaacatcggggatgaaccgcttgtctttttagaaatcttcaaagacgaccattatgctgatgtatctttaaaccaatggcttgccatgcttcctgaaacatttgttcaagcgcaccttgacttgggcaaagactttactgatgtgctttcaaaagaaaagcacccagtagtgaaaaagaaatgcagtaaataaaagacttgcggcttgcagagagcactcgttctctgcaagccttcataaggagctgaaccagtgaaacatcaaaacccttcaaaacgcttattgcggctctccataaagtacttgctggccgcagcagcagtggtgttgacctattttgctgtcatctatatattgttttctttagcgggaacgagctaccgctcagcagctcatgtcctgctttttgccgtggtatttcttgttctcggattatgctttgaaccatttgaaaggctgatgatacatagctttacatttttcaagacaggaaaacgtctattcattctccttgccggcatcgtacagctgctatttttgtggatgactgctcatacaacagaccaattgatcagcgacatctggctgtccaccacagaagaaatgattgtcgcagccgtttttttgattttagacaaatgcaactcggctcttcccagctaaaaaaagaacgcattccaattggatgcgttctttttattcatagcgaagcgcgtctacaggctgaagcttcgaagccttgatagacggaagcaagccgaagataatgccgactgccattgaaaagatgagtgctccgacaacagctggaatggagacgataaaaggcatcggaaaaatgaccgtcagcagcttggcgatgccgaagcccgccagcacaccgagtattccgccaatgcttgtcagcacgacagcctcggttaaaaattgaaataaaatcacacgccgcttagcaccgagcgctttcttaattccgatttccctcgtgcgctccgttacggaaacgagcataatattcatgacgccgataccgcccaccaaaagtgaaatactggcgattccgccaagcagcaatgcaaatgactgattaaaggactccacttcctgcgcgatctcctgaagatccattacactgtactctgctttttccagctcagcttctgacagtccctgatttaaaagatctgcagccattacacccgcttcttggatatgctcagaagaatcagcctgcacggcaatctgtgttggcgcgtcaaacccttcaataagcggccacacttttttcggcacgtacaaaaccgggttcgcatagtcgccttcaaacatgctttcctgttgatttttttctttaaaaacaccgacgaccttaaacggcacaccattcatctcaatgtttttatgcagagcttctccgtctggaaacagttcatctctgacagcttcattgatcatcactacttggtgtgtgctgtttaaatcgttttccgtcagctttctcccttcggttattcggattggaaacatgtcgaagtaatcatcgtccactccatacacttggggatacgaaacgtttgttaaatgaaaaacgctcgcgccttctgacaagtaatataaggataatcctttgaccatcggatctgatttgatcgcctttactgtttcttccgctacaggcggcgcggacgcatacgacacctgagggccgccgctctcctcttctccgccagacggctggtagacaacgttgatcgcgttgtttcccatgccgatcatactttgctttaattgctcactttggcccttcagcattgaaacaatcgcgatgattgccgctatgccgataatcacgccgagcattgtcagaatcgatcttaatttatgagaaaaaatggattgaaaggagattcgaatatgttcaagcatggctgatatcccctctctcatctaataccagctctccgtctctgataaaaacggttctgtcagcttttttggcgacgtccgggtcgtgggttatcataataatggtcttgccttcccgatgcagttcagaaaacagtgacaaaatttgttcacttgatttggtatcaagcgccccggtcggttcatcagctaaaataaacctcggctgattgacaagggccctcgctatcgccacccgctgcttttggccgccggacagcttaggcggtttgtaggagaccctgtcttttaatccgaccttttccagcgcttcatatgcccgttgccttctctcttttttcttcactttattgtagatcatcggcagctcgacattttgcagcgcggtgagacgcggcagcaaatggaaagtttgaaacacaaacccgattgattcattgcgaatttcggctaaagccccgtctttccctttcaatatatcgatctggtcaagcgtataggttcctgaggttggcctgtccaaacagccgataatattcattagcgttgactttccagaaccggaaggccccataatagctaaaaactcccccgcctgaacagtcagattgatatgtttcaagattggaacttcttcttttcccagcttgtacgacttcgaaatattattcagtgtcagcattgactgtaacctgctttccttccttgaccgcgggatcaggatagatcacataatcttccggcgtcaggccgctcttaatttccaccatgtcattttcatcagtctctccgatttcaacaggctgcttaaccgctttgtgattctcatcagctttccatacgtacggttcgccgtcatcctgaatgaccatgtcggacggcagcttgatcgtgtccgcatcagcattatcactcatcacttcgatgttgacatgatagccgacttcaagacctttatggctgtctaataaaatggtgaaaggatagttagaggactggggattcatttcttcatcagcaaagctttctgattcttcaccctcgcctgctcccgctggaagcttgccgatcgaggtgacctttcctttccactcgccctcaccgcctgttttcagcgtgaccctgactttgctgccttttttgatcgtgtccattaacagctcattgatttggcttttgaccagatatttgcctgtcgaaacaatctggatatacgggcctgctgcctggtcgcctgttgcaccgtcagcgatatcctgattgacgctttgaacgattccgtcatgcttgcttgtaatgacattggaacctttgtttttcgtcaggccagccagttctttttgatgctgcttcagttcaagctggcttgttttcaaatcgaaattggcttggtcaagttcatcttgaagctgggttttctcttctttccctgcaactttcagcttcttttccgtttccgttattgatttttgcaaacggttgatttgcagatttgtcatttcaatttgcaaattggcttgctccacttcatcagaatgatcctcgccctcatactcaaaaagcttatcgccctttttaacctgatcgccttctttgacgtatgtttttttaatgctgcctttttctgaatctatgtatactttctgctgtttctcaggttcaacctttccagaaaacgtttggcctgattctgaatctcctcccatgtataccgcgaccgattcagcatagggctccgatgatacggcaacttggttcatgtgagtaaaaaagtaaaaaccgccagcgccgatcccagccaatacaagcacaccggcacatatcgcaccgccaataagccattttttcttcttggacacaacgatctcctctttctgtaaactatgtaatattttcgaaacattctaaccaatattatctattaattcaaaaagacttgcaatccttttattgaaatgacggaatcaaatagaaaaattgtattttccaagccgaataaaaaaaatcccggcttcaaaccgggattttttcatacagtaactagctctttttcatttttaatcaagtcatatgtcaagcatacaggtttatttgtacggggatcagtcacgatttcggcatcaatctgaaatacctgcttcaaaatgtctggtgtcatgacctccagagcagttccttccttgatgaccgtgccttttttgagcgcgatcatataatgagaaaaacgagctgcatggttaagatcatgaatgaccattaaaatcgtccgcccttgctctttgttgagtctgtcaagcagctgcagaatttcaagctgatgtgcaagatcaagatacgttgtaggttcatccagcagaagcagttccgtcccttgcgcaagcgccatggcaatccacacgcgttgacgctgtccgcctgacaatgcctcaatcggccgttcagcatattcagccatgcctgtttcttcaagcgcccatttgataatccgtcggtcttcgtcatttaatctgccgaatcctgattgatgcggaaacctgccgtacgacaccaattcgtgcactgttaggccgctcggcgcttcaggtgtctgtggaagaatcgccatatcttttgcaatgtcctttgtagacattttatgaatcgctttgccgtttaaatagacggcacctgcatgtgaacgcataattctggacattgtttttaaaatcgttgatttcccgcagccgttcgggccaattaaggtggtaattttccctttaggaatcgatatatttaaatcctctacaatcgccctgtcgccataaccgattccaagctgttccgttgataatgaattcatattcggccccctcctctaattcgctttcatcaataaataaataaagtaaggcgcacctagcacggaaatgacaagtccgaccggaatttctgatggtgccaatacatttctcgccagcgtatcagcaagcaaaaacaggaatgagccgatgaaggcggagaccggtatcagcgtctggtgacgtggaccggtcagccttctagccacatgcggcgcgatcaatccgagaaacgcaatgccccccgcagctgccacgcatgaagcggcaagagtaaccgctgccagaagaagaatccgtctttccttttcaacagcggtgcccagcccggtcgccaattggtctccgagctgcataatgttcaaatagcgtgccttatataaagtaaacagaagcaagatcacaatccaagggagaatcgcccagatcatattccagttcgccccccatattgagccggatatccaaaccgcggcttgcataaaatcatgagggtccatcttaagctgaaaaatcagcaacagggcattgaatccggcattcacccctatgccgactaaaatcagccgaatcggtgtcacgccttttttccatgccagaatataaatgagaaacgcagcgaggattgctcctgccaaagcactgaatggcagcataaatgttccgaaaaagctgagatctgaagctgacccttgaaaaaagtatataaaaagcactacagcaagtgaaccgccggcgttaattccgagaataccaggctcggcaagttcattttgagacacgctttgcaaaatggctccagctacggagatccctgctccaacaagcaaagaaaggatgatccgaggcagcctgaactcaaataagacaagttcatcacgcgccgttccttggccgaaaaagacctgaagcgttttaagcggtgcaattttgataacgcccaaattgagactgataaaaaagaccaccacgataagcaaaaaggtcacagccattacaataagcggtttgtttgtttttgttttcattacagccctctcctttcacgacgtgccaaataaaagaaaaagggaacgccgatcagagaagttagcgcaccgacaggcgtttcaaagggcgcatttacgagtctggccgctatgtcagcaaaaacaagcaaaacagcaccgagcaccgccgagcaaggaatgatccaccgataatccacaccgaccaaaaaacgggtaatatgcggaatgatcagcccgataaatgcaatggtgccggcaatggaaaccgcagctccggtcagaattactacaataagcatgcccaccagtttcactgctgatgtatattgtccaagccctttcgccagatcgtcaccgagacttaacactgtcacagatcgggcgataaaaaacgcgagcgttaaaccgacagcccctgcaataagcaaaagctggacccccgaccatttcacacccgctaccccgccagcgtaccaaaagctgatatcctgagcgacatcaaagcggattgcaatggcagttgaaatgccggtaaagaaataagtaactgccgtacccgccagagcaagctttacaggcgtaagtccgccccttgaaaacaagccgatgcccattaccgtcgatgcccccagccccgctcccgcaaaggaccatagcacaagccccattgcagaaagtccgggaaaaaaggcaaacgcaatcgaaaccgcaaacgcagagcctgatgtcacacccataatcgaaggctctgccaaagggtttctcgtcatcccctgcatgattgctcccgacactgccaacaatgcgcctacaagcgcggcagccgccgttctcggaagccgaagatcatgtataatttggtgagatgtctttgtcggctgataatgaaaaatggcgtcccatacagtgcgcaaatgaatatccgctgcaccgagggatatggataaaaatgcgccaaggcaaagcaggcatagacctgcaataaggacgatgaccgcgccatatgtccttgacgtccattggatttcttctgatgcagtccgtatatttttatgttgactcaactgccgtacttcctttctgttactgataatgattatcaattgctgtttcagtatatcacttttttcagctgatttaatagagtgttttgaacaaaaatgaaaatgcatttgcaaaaatatcgtgtcaaccggcacttgcagtggtataatcacagatgataatgattctctttttcatctattttttagaaagaaggtatgagatatgacccatatatacaagaaactcggagccgcgttttttgccctgttattgattgcagcgctggcagcctgcgggaataactcagaaagcaaaggttctgcctctgattcaaaaggcgcagaaacctttacatacaaggctgaaaacggaaatgtaaaaatcccgaagcatcctaaacgggtggttgtcatggcagacggctattacggctacttcaaaacactcggcatcaacgttgtcggtgcgcctgagaatgtatttaaaaacccttactacaaaggaaaaaccgacggcgttgaaaacatcggagacggcacttcggttgaaaaggtcattgatttgaaccctgacctgattatcgtctggacaacacagggcgctgatattaaaaagcttgaaaaaattgcgccgactgtcgcagtaaaatacgataagctcgacaacatcgaacagctgaaagaatttgcaaaaatgacgggaactgaagataaagctgaaaaatggctggccaagtgggataaaaaagttgcggccgctaaaacaaaaatcaaaaaagcggtcggtgacaaaaccatttccattatgcaaacgaacggaaaagacatttacgtattcggtaaagactttggaagaggcggaagcatcatttacaaagaccttggcctgcaggctacaaagctgacaaaagaaaaagccattgaccaggggccaggttatacaagtatttcattagagaagctccctgactttgccggggattacattttcgcgggcccatggcaatcaggcggtgatgatggcggcgtttttgaaagctccatttggaagaacctgaatgccgttaaaaatggccatgtctacaagatggatccgatcggtttctatttctctgacccgatttcattagaaggacaactgaagtttattacggaaagcttgactaaataaacaaaagagccgcctgcccgcggctcttttgcaaatttataaggaacagctcaatttgaatcatatcagatattttctttgagccattcatattaagctgcatcctcatcgcgatcagtttttttatgctggagagactgaaaaacgttttttgcatattcgattgtgccttaaagtttttctttcgatttcagctttcctgtcagctaggttaacgaacggattcttaacagaagaaattgtgattttataaaaaagacacctgagcaaatcaggtgtcttttcattatgcttgtttttctttctggaactttttactcacaaatgtataaacgattaagccgacaaagaataaaccgatgccgaggataaatgtcgttaaatctgctgtgcctgttacgataacaaacacggagtatgcacacgccagtatcgcgatcaatccgtctcttacacgggagcctttcagctggtcatacgtttcacctttgatgactaccttcaagctgtagattgcagataccagatacggaattaaatatgcgagtgtagccgctgtcgttaaaaatgtaaatgcgtcacttattgtccgggaaataaccgagaaaatgaagacctgtgacatgacgtttgtaataatgagtgcaatgaccggacttccctttttattcgtttttgcaaaaaatgccgggaaatctcctgctttagcggcttggtatggcacctcagagccaagcaaaatccagccgagcatcgttccgaataaacaaaggatagccaaaagcgccataatcacgcttcccgcgtttccaacaatcgcatagagtacatcaacaaatggtttttcagagccgacaagcttatcatgcggcagaacacccatcgtaattaaagtcacaataatatatatgctcaaggcaatcagcaagccggtaattgtcgcacgtttcacatcacgctgagagcgcgcacggccggacaggatcaccgcggattcaattccgacaaacgcccacagtgtagaaatcgcggcgttatgaacctggccgccaattccaatgcttgtgccgttttctccttgaaccgggaaataaaaatgaccgaataatgtcgtttgaaacacaaacaaaccggcaacgataaagaagacaaaacctaatactttagaaagcgttgtgacaaagtttaatttacttgcgccgttaatgctggcaacaagaatcgcgtgcgttccccataacaagatcgtacatacggcaaacgtcagtaattggccgagtgtcacctcttgcccgccgatcgaaaacatctcacgtttatcaaccaagatcgggaagaacgaagtcaagtaaccggcgagacttgtgatgatcgccacgttgctgatccagctcgccacccagtagccccacaccattgtgaaaccggcagcgttgccttttttcgggtcagaaaacagcgctcttgcataactttgcggtcccgctgtcagttcaggcttgcgaatggacaagtgtccgaacacaagtgcaatcatcagcacgccggcacctgtcaaaagccaggcggacgtagctccaaacggactcgcaattgaagcaagcgagctcggcaaggagaaaattcctgatccaaccatatttccaacgacaaacgccgttaataaccaaaaaccccatttttttgtctgttccattccagtacctccatgattctttgtacggaccagaccccgagatcatataaacgcaaaaaaagcctgaacaaaagtccatgcttaaagaaacacacacccttgatctccggatagccctccgcgaaaaagcacgcggcagtcctgcacttattcagatacagtcccagcatagagaaggatcggctttctccacacttcggcgctgatgccttttacacatgtttaacagcccctgtcagcctggcatgtgtgacttatcatccgcgcaacctctacctcactgagaaagagtgaggatttaattattcagttactcccagaaggttatcaaagaaaggatgatctgtcaaagggaacagatggaaaatacggatagagccaagccctatccgcatgtgattatcgattatttttctttttttgcacagcttcttgaagcggatcatcttttagagctgaaccagcatcttcaagagctccttggattacgtttttttctttttcggaacgttttcctttatctttattaaagaaacccattcgtatcacctcttttaaaaaataggtacatgtttaagatgcctcttttatgaaaaattatgcgggatattttttatcgtccaaagtcctgttgatcaaacatacattctcttgatatatttgtaattcagagattttttgcaaaagataaaaggagaagcggcaaatgacaggaaaaacacacatcatgggaggcatcgcttcttgtacggcagcggcttattattatggatttgatccagtgcttatggctgcgtcaggcgcggttggagcattaatacccgatatctgccacacacaaagcaaaatcgggagaaaatttcctattttatcgaaagtggtcagctccgtttttggccatcgtacatttacacacagcttgctgtttatgctcatcatgttttttatcacttctacatacattccagataaaaacatatcagccggcctgatgatcggaatggcaagccacttgattcttgacgcttggacggtaaacggaatcaaattattattcccttcaacgatccgcgttcggcttccattatatatgaagacaggcagtttttctgagcagctcgtgctagctggcctgacccttgcttcatgttactacttttatatgctgtttcatgggcgcatgttttaaacatgagtgctgagacttgtctgaaccggctgtttttagtaggttttacttaagaagcatttcatgcagatgatcaagaaaacgcgaggagtcatattgatgaaaggaaccttttttcacaatcagcggtttttatgtttttcgatcttatttatgtggatcaaaacgtatgtgatatataaactcggctttgatttgcaaatcgatactctgttggaggagctaatgctgctggtcaacccgctcagctttattcttcctttattcgggatcggcctgtttctaaaagaaaacaagcagcgggcctttttgctgatcgccaatttggttctgactgttatcttgatctctaatacgattttttacggcttttatatcgattttattaccatcccggttttatttcaggccagcaacatgagcgatatgggcagcagtgtaaaagaactgttccatcctctgtttatcgccctgtttgtggatttggtttttctgctgctgttcgccagaaaaaccaaacacccacagacaaaagccgctccccgcacgatcaaacggtactatgcagcttcctgcggcatgcttttatgcacactggcacttgcagaagtacagcagccgaagcttttggcacattcttttgaccgggaaatgctagtcaaaagcatcggtctgtttcagttccatatttacgatacaatttctcagactgttaatatcagcgcgaaagcttttgccgatgaagacagtataactgccattaaaaactacacagaggctgattacagcaagcctgatcaaagcaaattcggtcttgcaaaggggcgcaatgtcatctttgtaacacttgaatcgacccaaagctttgttctgaatgaaaaagtaaatggaaaagaaattaccccatttatgaatgatctcataaaaaaaagctattcctttgatcatttctatcagcaaacagaacaaggaaaaacatcagattcagaatttatcgtcgctaactcactgtatccttcccttagcggcgccgtctttttcacgaaaagcgaccatcaatttcatacgatgtataaatcgctgaaacagcacgattattattcagccgtctttcatgctaaccataaaacattttggaacagagatgtcatgtacgatacgtttggcattgaccgcttttttgatgttgatgattttcatgtcactcccgggacatcgacaagctggggcttaaaagacaaagaatttttagagcagtccgccgaaaagctgaaaagcctgccacagccgttctacagcagttttatcacgttaacgaatcattttccgtttgagattgatgaaaaggatcagctgatagatgaattcgattcaagcagtgatctgttaaaccgctatgtgaccacggttcgctatgaggatgaagcattgaggcattttatcaaaaaactgaaagacgaaggcttatacgaaaattcgatgatcgtatttatgggagatcattacggcatttctgaagcccataacgaggcaatggctgagtttttagggaaagacgaaatcacaccgtatgacaacgttcagctccagcgggtgccgtttatcatacatatcccgggaatcaccgatcaaaagccggaaaccatccctgatgccgggggacaggtcgacgtcaggccgacgctgatgcatttgctcggcgttgagacaaaaggcgatatccaattcggcaatgatttgctgtcgggcgaccgcaccccattcgccgttctgcgaaacggcagctttattacgaacgattatatatacacaaagaacacgtgctatagccaaaaaacaggtgaagtgctggaagatcaggatgcgtgcctcccttataaggagaaagcaaacgaagaactgtctttctctgataaaattttaaatggtgacctgctcaggttttccgaatgaaaaaaatccctctatcaagagggattttttacgtttccaatatcaccttgccagtcagcttcgtttcatagccgtttaattgagacaaattcgccttgtattcctcagaattcaaaatctccttcacggccttaagcagctgctcatgttttttcaaaacgacaatatcatattgttcgtcgatgagcgggataaaatcaacactgcccatatgtgccgcgtgctgtgccccgattcccgcgtcagcctgtccgcttgaaacttgtgaagcggcagcgtaatgatcggtcacgatatcgtcgtatccctttacatcagccggattcacaccaagcaagccaagctgttcatcaaggagcacccttgcgccagaacccttttccctgttgatgatccggatatcggctcttttcaagtctttccagccttgaatgtttttcggattccctttttgcacatacagtcctgctttccggagaacgacattgatgagacaaaacggttcacctgtcaagatccgtttcacataaggagcgttatactggcccgtttcagcatcgtacaaatggaggctgacaatgtcacacttgccttgatacatatcaatcaggctgtttaagcttcctttgtatttacggagcggcgtctcttgaatggcattctccaaatgcttgctgagaagatccatcgaaatgtcctgtccgctgatcatgacattcggtctgccgtccggctcagcctcctgcacctgtttcggtgcttctgttgcagcgatgggctgagacattctcatattcgttttatattgctttaaatcttcttcatccacacgcatctgccttccgacacgataagcaggcagcacgccttttttaatcaagtcataaacggtcagctttgataccttcagcagacctgcaacttcttctatcgtataggaagaggtttcattcatcatcatcactctcctattttattataccttttcgttgaatgtaaaaaaacccacataaaccaaacataatcagttataattagttatatctaatgataaggggtgcaatcatgtttaagaagtattctattttcatcgcagccttaaccgcttttctgcttgcagcaggctgttcttcaaaccagtcttcaacggacagcgagaaaaaagtaacgttaactatctcagctgccgccagcgcgcaggatgcacttgaggaaatccaaaaaaattatgaaaaagagcatcaaagtattaccatccaagataactatggctcatccggcgccttgcaaaaacagatttctcaaggagcaggagcagatctgttcttctcagctgctgaggataaatttaaaaagctggtggatgatggagatatcgcaaaaaaagacagcactgatttagtcggtaatgaaattgtgctggtcgtaccgaaaaacggagattcacctgtgacaagcttcagcaatctggctgaatcagaaaaaatcgctctcggcacgccggaatccgtaccggcaggagcttatgggaaagaatcactgacaaagctgtctctatgggacaaagtgaaggataaaattgtgtatggaaaagacgttcgccaagttctttcttatgttgaaactggcaatgtagacgcaggtattgtttataaaacagatgccctggtctcgaaaaaggtcaacattatcgacgaggcaaaagcagatacacacagcccaattatctatccgttaggaatcgtaaaagatacaaaacaccgtaaggaagcgaaggaattttacgaatacctgcaatctgatgaagcaatgaaagtatttgagaaatatggctttactgccaagtagcataagcgcttcagaatttttcacacccgttgtgctttcctttcaggtggcggcagttgccggaattgttgtcattattctcggaacacttgctggagcatggatgtcacgggcatcatttttcggaaaaacggcactcgaaacatgttttatgcttccgctcgttcttccgcctactgttgtcggttttattttgatcgtcattttcggaaagcacagcttcatcggacaagccatcgagtggattttccagcagcctgtcattttcacctggtgggccgctgtgatcgcctcggctgttgtagcctttccgcttatgtatcaatcagccaaaaccggatttgctgacattgatcccgatatacaaggtgcggcaatggtagacggcgctagcagatggaaagtgtttatccatatctccgtcccgcttgcctatccttcgttactgaccggaagcatcctcagccttgcgcgggcgctcggagaatttggcgcaacactcatgtttgcaggaaacatccccggtgttacgcaaacactgccgacggcgatatatgtcgcattggattccggcaacaatacccttgcttgggcgtgggtcgtctgtattgttgtcatttcctttttgatgctgtttttcattcaacagaaaaaaacgcactaaaaaaactccccataacagggagttttttgattaaaacagaagctcatcaggatttgggccgacacgctcatctttatttaatgcgtcaattttgtccatgtcttcttgagacaattcgaaatcaaaaatatcagcgttttcgatgatacggtgttctttaatggattttggaatggttacaacttcatgctgcagatcccagcgcaaaatcacttgagccacagatttattgtgtttttcagcaatctgtgtcagtacttcgttatccaaaagctgtccctgcatgagcggagaccacgcttccagctgaatgccttgcgctttgcagtaatctcttaattctttttgcgtcaagcgagggtgaaactcaacttggttcaccatcggtttgatttcagcatctttcaacagctcttctaaatgatgaacttggaagttgctgacgccgatcgcgcggattttgccgtctttgtacagcttttcaagcgcgcgccatgtatctttatatttatctttgccaggccagtggatcaaatataaatctaagtaatcaagctgcaatctttccagactcttttcaaaggcagcaagcgttgtttcgtagccttgatcttcattccacacttttgatgtgatgaagagctcttctcttgccacaccggattctttaatcccgatgccaacgccttcttcatttttgtagatcgctgctgtatcaatgctgcgatagccatttttaattgccgctttcactgattcagtcgcttcattaccattttctactttaaaaacacccagaccgaaccaaggcatttcaactccgttatgtaactttacagtatcttttaaacttgttggcacttgaacatccaccctttcactgaaatgtaagcgtctatattatctcacattcctctcagccgataccaataatacgcttaagaccctctttttgcttcttttttcacagcacaggcaaatccaaacactatttttttcctattttaacaatattgagattacaaatacattgagcagggtatgcgtgtagtgtaaccaaatgaaaacaaaggaggaaacaacttgaaacgtattcgtatcccaatgacacttgctcttggtgccgctttgacaattgcccctttgtcctttgcttccgctgaagaaaatcctgctccgaagatgtcgcagacaactgctgctggaacaactgccgctgatgtaggtttaaacgtcaatctggatgtacttggaattgccaaccagatcgctgatgccatcaaatccgcacagaacagggatgggtttgtgaaaaacctcatggagtcttccttctacgcatccggccaaaaatataatgtcatggtctttaatttaagccaggaatatgaagatcatttgaacggtgtgcaattttacggctcagccgtttacgacggcattacgtatggcatttgggtatttgaagatggaacctttacaaacaaaggcgatggcggctggatcaactgggccttcagaggctggttcgaccgggatggcagcactgtcgcatttcatcgcccttaatatagaaaaaagctggcgctctaacgccagcttttttgctgcatttattcgccgccttcaagcatggcggcttcgacatcattaatgtattggcgaagctcatgggagatgtcccgggaaatttctctttcctcgaaaagtgtttgaatttcatttctgatcgcctgtacagccttcagcttcacttccagcttctgattttcaaaatgggcgcttgatttcagctcatgatggctgtgctccagcctgaaaattaactgtttatagaatgtaatgacagataaaaacacttctttatgctcttccgtcttgtgtttttccagatattctatcgctgcttttgccgttttcactcttgttgcccgtatcaatcccgcttcatttaaaatcgacatctccggctttttatgttcaccgaagaaaatccaatacatcagcctcttgagccttgtttttgataatccgactttaaacgggttcgcatacaaaatttccaactcgttaaatcgttcttgcagcacatttgctgtttcttccgggatgtctccccgctccagcattttcatcagcgcctcttgctctgccttaaccccttgggcacggactttacgctcgtgctttttgatgcgattagacgatgtatattgctgaaaacgaagatttttcattttctcattgtattcagctatcaccgcaagcgaggccgttttgtttgtctcattcatgtcctctttaatcgtttgaagggctgttttgatcaatttgcgtctcgccgtcagcagcttcttgtttcgttcctcgtcctcttcttctttttcagtcagaatcggcagcacaacggtagcaatgacaagcgtgcataaaatgacgccggctgctaaaaagagaatcagatttctttccggaaacggcgtgccgtcctccaggaaatacggaatggaaaaagaacctgcaagcgttactgctccacgcacaccggaaatcgaaattaacagcgtcgaacgaagacccggtttatagatgttctgatctttattaaagaaccatttgccgttccagaagaacagcacccacaggaatctcaggagcattaacgtaaatgtgatgactaggatatagccgatcaccttcatgttgctgatggcagtgtcgttaaagataacagaaataacatcagggatttgcgtgccgagaataacgaagaccagaccgttcaaaataaataaaataatgttccacgtacttgaggagacaatttgcagcttgatcatcgttgattccagacgatcctgttcaaccgcatgggtaataccgccagccacaacagctaaaatgccggaaacgccgatttcttcagctgccaaataaatcacaaacggcgtcagaatttgaatcagcatatgcatcgtgacatcctgcatgccaaggcggcgcagaaataggcgaaaacgaataatcaaaaatgaaatgacaaccccgcacagcaagcctccgagagaaataaagacaaagctgacagccgcttgtgctaatgaaaatgcgccagtcactgccgctgcaatcgcaaacttaaaggccaccagacctgatgcgtcattcatcagcccctcaccttccagcaggcgaagaatcccttttggcattttcactcttcctgataatgcgctgacagcgacgacatcagtcggtgaaagaatggccgcaagtccaaaggccgctgccagcggaatagcaggaatcatccagtgaatcgtgtagccgcctacaatcacagtcgcaaatacaaggccgagtgcaagcaataaaatcggagcccttaaattccaaagctctgcccgcggtgtcctctttccatcattaaatagcagaggcgcgataaaaagaacaaaaaacaattcggtgtttaattcaaaatgaagtccctgtggaaatgaggcggcaagaatcccaagagccacttgaatcagcggcaccggaataaacggaataaaccggttcacgatattagaaatcgcaataatcgttaataatacgagcacaactaaaaatatgtccaaatgcatgacctccttcgtctgttgtgtgtcggcatgatgagccaaaaaatctgtttgtctaaaagcccttgagctagggtggccttgcatccgctatgtggttccgcaggagttctctccacacttgtcttcttttatagtaccctttttagggtattttttctcatgatatgctcacagtgaacttttttgcagcagagcaaattacagaaaaaagagacaggaagctactccctgtctctcgtctttctttctcaatcatgaaaattcgtaccgtcagttgttgctttgataatgcccgcgcggatgacaaagtcaccgaaatgctcgccttcctcacgttctttcgcatagcgggaaagaaggatgcgcagctcgcttaaaatgtctgcttcaccgatgttttcacggtacattttgcttaaacggcttccgtcaaacgcagcgccaagatacatattatatttgcccggcgcctttccgataaatccgatctcaccgagtgcatgacgtgcacagccgttcggacaccctgtcatgcgaatggtgatttcctgatcacgaaggccgttttcgtcaataatctcttcaatcttatctaacagggtcggcaaataacgttctgcttcggccattgccaatccgcaggtcggaagagcgacgcatgccatcgagctgcggcgaagtgctgaatagtgcttgccgtcagttagtccgtactgttcaattaaagcactgatttcttcttttttatcgcttgaaacgttcgcaatcattaagttctgattggctgtcagccggaactcacctgtatgaactttggcgatttcccgcaagccagtcatcagcttataatcatcgtaatccgttatacggccgccttcgacaaacagcgtgaaatgccatttatcctcgatgccttccacccagccatagcggtcgccgttatgatcgaaatgatacggcttcgcttcttccaggctccagccgagacggttttccaattcttcttttacgttttctaaaccgaggcggtcaactgtgtatttgaaccgcgcatttttacggacagaacggttgccgtaatcacgctgaatcgtaatcgttttttcagcaacgtcatacatttgctcaggccggcagaatccgatcaccttggctaattgcggatatgtcgcagtatcgccatgcgtcattcccataccgccgccgattgccacgttaaaaccgatcagcttgccatcctcgacaatcgcaatgaatccgagatcttgtgaaaagacgtcaatatcattagacggcggaacggcaataccgattttaaacttccgcggcagatagagcggtccgtacattggctcgacttcttcctccggcgtgccggcaactctttcctcatcaagccaaatttcatgatatgctctcgtccgcggcagcagatcatcacttaattttttagaccactcgtatacctctgagtggatttcagattgataagggtttgatgcacacatgacgttacggtttacgtctccgcaggctgcgatcgtatccaaaagtgctgagtggatcgtctgaatggttttcttcatgttccatttcagaatcccgtgcatttggaacgtttcacgtgtcgtcaattttaatgtgccgttcccgtatttctgggacaggtcatccatgacaagccattgttcaggcgtcgagacgcccccgggcatacgcacgcgcagcatgaactgatatgcgggctcaagcttctgcttttggcgttcatttcggaggtcgcggtcatcctgcaaataactgccgtggtgtttcatcaggcggttatcatcatccggaattcccgcactgattcgatcgagcatcacttctttcagcgtgccgcgcaaataatcactttcttttttaatgcgttcaacatcacttggagagccgtccggtgcttttagaattttggtcaccatgttgaaaaactcctttcaagtcaaatcaatatacatcacgctgatagcgtttttgctgctgcatatcggcaagataagcctccgcttcttcgcggctcatattgccttctttttcgataatttcaagcaatgtgttatggacgtcatgcgccatgtgcttttcatctccgcaaatgtaaacagccgctccttcttgaagccattcaaacaattctgcgctatgttcaagcatgcggtgctgcacatatactttttcttccgtatcacgtgagaacgccacatccatttttgtcagcacaccgtctttgagccaattctgccactctgtctggtaaaggaaatccgtgacaaagtgctgatcgccaaagaacatccatgcctttccttccgctcccgtctcctcacgctcctgcataaaggaacggaaaggtgcgacgcctgtcccagggcccaccatgataatcggtgtttcagggtctttcggaagcttaaagttttgattgtgctgtacataaaccggcagtgtgtctcccggctgcagacgttccgcgcacaaaatcgagcagacgccttttcgttcacggccgtgcgcatcgtagcggactgcgccgattgttaaatgcacttcatccggatttgcggataaactgcttgcaatcgaataaaggcgggcaggcatttttcgcaaaatcgagacaaactcctgcgcagatacactaaatgggccatagtcacggacgagatcaagcaaatcgcgcccttcaatataggcttttacattctcctcatttcccggggctaaaagctctctaagctcatcgttccctgtcagctgggctgcctgttcaagaagcggttttgtgagaacggtaatctcatagtgagaaatcagcgcttctttcagcggacggacatcaccttgcttattaagcgtcacaatttcttccgggtcccaattcatttccttaaggagcagctcgacaagttccggatcgttttctggatagacgccgaggctgtcaccaggctcgtaagtcaggcctgatccttcaagagacagctccacatggcgtgtttctttatttgatcctctgccgtttaaatttaaattttctaacacttcagcccgaaacgggtttgttctggaatacgaagactcaccggtttgtgacgcagccgccggcgcaggcgcggcggttccgcccccagcttcatttaatcccttcaatacaccctcaagccattcggctgccggttcatcatagtcaagatcgcaatcaacgcgcggagaaatccgttttccgccgagttcttctaagcgctgatcaaattctttccctgtctggcagaaaaattcgtacgaactgtcaccaagcgccaaaacggaaaagcgcaggtcttcaagcttaggcgcccgtcttccgtgcagaaattcatgaaacgacagcgcgttatcaggcggctcgccttctccatgcgtactgacgacgattaaaagattggttaccttcttcagctgattcggcttaaaatcgctcatggatgagacggtcacttgaaaaccgctctgttcaagctgcttgccggcattttccgcaagcccctgtgcgtttcccgtctgtgaaccataaagaacggtcacttcttttgaaacggccggtgcttccgcagacacagctgccgccggcgcacccgcagtttcttgggcggaaacagattgcgcggataagtatccgctcagccagattttctgggattcggtcaaggtcggcagaaggcggttaaggagctctgcctgctcctgattaaacggactgttcattacctgaagttgcaacgtatccacctcacaaagttataaactgatcgaaaattgcatctaattgaactttaccggaatactaggcttaagtaaaatatatttacatgatgataactattaagaatcctaatgataaaacggctatgcttcatgtaaatagaaaaaagagaaggactcccttctcttcattcagccatctgatataagtgaggcggcacagcggttacaaacggactggcttcacctgtataaaatactgccagcatgtgcatcgcacgggtgcacgcagtatataaaagcctgcggtcgtgctctgtatgatagtgttcttcagatgcatcatagacaagcactgcgtcaaattcaattcccttcgctaaatacaccggaatcacgcaaacacccttttgaaatggttgattttctttatgaatcaggcgaacatctgtatattcactcatgtgggcgtgcgcctgtatgcattgctgcgcagtcttgcagatgacggctattgtttcgcgcccttttttcttgagccggccaatttcttgcgcgagcttttggcaaaggctctcatgtccttcagttttgacaacgagcggcatttccccgcttctattaaacggctcaatatccgctccatattgaagcatcgctttggtaaactcgacaatctgccttgttgatctgtatgttctctttaaacgaacatactcagcaggctcatcctcaaagcacgcatccatacgctgatccccgtgtatggtatgcgcgtagatggactgattgatatcaccgagcactgtcatgctggcagccggaaaaatgcttctcatgtaaaccatctgaaacggtgaatagtcctgagcttcgtcaataaatagatgtttgatcttcgtatttttctttctgccctcaatcagatcctgcatataaagaaacggtgctgcgtcctcatagagcaatttattatccgtaaatgccgaactggtcagctcacctatcgcgtccatcttctcatgctgaaattttcctccccagccagaaaacaattgcaaataaagttgtgtaacatcaagaaatgcaaggagtctgaccgcctgtttgagcggtttgaaagcttttttcacaatgatggcggcaagcagctgctgctctctttgataatcgttaaacgtactctcgctgaaccgtttcctttcttgcagttttctgtacacgtccaagtagtcctctttgtcaagcagctcagcttcatgaacaacccaatcctttcgccgttcctttttctcaagcttgttaagctcactcagcagccacttcgcggtttgctccatccgattcggaatggagtgattttgatccaatgagtaaaaataggattgaatttgctcctttgtgatcagcttttgtccgcggaatataatatttttaaaaatcatcccttcagaggaaagccgtgtgacgtattcattaatgaattgctgaaaggataaacccgccttccatgtgattcccgcaagccttgttggaaaatcgccttccttagtttcggtcaggcaatattcgagctgatcaaaggcgctttcacatttgaacttgcggccaagacgatgctcgatatattcctgaaacgtcgcctgctccatattctcttctcctaactcaggcaaaacagaggatacatagctgttaaataagaagttgggagaaaacaaaacgatttgtccggcatcaatgacgccgcggtgcctgtataacaaataagcgacacgctgaagcgcagccgatgttttcccgctgccagccgctccctgcacgatcaggatcttgcttttttcattacggataatctgattttgttctttctgaatcgtagacacgatgtttttcatttgggtatcggagtgatggcttaatacctcttgcagcatttcatcgccaatcgtcatatcggtattaaacatcgccttgagagtgccgtttttgatcataaactggcgtttcagcaccatttccccttctatcgtttcaccgggcacctcgtactccgcttttcctggagaataattgtagtacaaacttgatatcggcgccctccagtcatagatcagaaagtgttcctctttctcatccaaacaggaagctaaaccgatataaattcgctctgcctccgcctcgccgttttcaataaaatcaatccggccgaaataaggcgattttttcaattgatgaattcgtttgagctgctgatccatgcgccgatgattctgttcccgatcagacagcagctctgcctgctgcttaatgcttgccatcgtttcaatcgcttcatgggcatcatcaaaattaaccttaacatcctcccaaaagctttttcttaatccgatgatatcatgcttcaacccgcccgcagacgtttccagaaaccgctcttttttttcgagctccttcagcacctcatctattctcgactgctcttccttccattccttatcctgctgattcatgaacggcacctccagaaaatagttgacaaacatagatgaaatactgtaaaatataattggatacatatattaaatatatgatgtaaactggcaaatacaatttataatagcacattcacccaataccaatcaaggtttgggttatttatatgcagaaaaaaccgatttcaactcgaaatcggttttttctcttatgatttcacattgatcactgttggacgtgcttttcttaggttgcgaatcttctctttcatcagtatcgattccttattcctttcaatcttcgatataatatatctttttcattttaaaaacaccgcagagctttaccgtatttgtctgttcatctaacgtgaagaatgactaaactggctgttattgtcatcttccataaagcaactacatctctgctatcgtatctatagtcgcagtaaaatagtcatttttcacccattttcgacacatttcaacaaattaaagtttttcatttgggagaataggacgatgttacattatttctctcggtttatgatatgaacatgaagaaagaaccagaattagttaggaggaaatactcagtgaagaaaaagctatctatgttgttgctggcattcgtcgtagccgtaacaagttttacgtcaattgacctagtaaacaacaaagcggaagctaaagattgggttaaaaaaggtcaaatatggagtactcattaccattcgggctcatttaaaaactatacttactcgccaacttttcatatttattatccaggacgaggaacttgggccaacatgacatcaaatggatcaggcagcgggaaaattacagcaactctgcaacaaaagacaaataaaggctggaaaaatgttaaaactttttacgcaacgaaaaaaggctctacaaatttaagttacaaacaagcttctaaaagctacaaaacaaaatacagattcaaattcactaacacaggaactaaaaaaaccatcagctataccttttgggctacctattaatttcaaatagctttgctctgcgcggtcagcattcgaaaaggactttttatttgatcccggcaggctaccataaaagaaacctctccgtcatggagaggtttcttttattttactgactatctaagcgaaaagaacggtttggcagcttccaattaaacatataggaacaaacccggcaaacaacgagcacgaaaaacagaacgtataagccgaacgagttccccatccagcccaagccgacgattaaaccgccgagagccgcccagactgcataaatttctgccttcagcacaagcggtttgcgaccggcaagaaggtcgcggatgattccgcccccgcttcccgtcagcaccgcagccacgatcacggcactaagcggatggcccattttgacagcatacagtgcgccttggatagcaaaggcagcgaggccgatcgcatctgataaattgccccacttattccaatgcttcagcagcagcttcggaaacagaaacacaattgtaatagataaaagcgcgatttgaaagtacgctccctgctcccatagcgctgacaccggaacaccgatcagcaaattgcggatcgctcctcctccaaaagctgtgacaatccctaatatataaactcctaaaatatcatattcctcttccatcgcaacaattgcgccgctgactgcaaacgcaatgatgccaatcacactaagcagctcccaagccattctgatgactcccttttatgtttgttaaattttctgacgacctctagattttataatcgctccagcgtaaaatcaataacatttttatgagaaaaaaagataaatttagagggaatacggctattgctgatggacatgagtttgcgaaattaaaaaagcgcccggcatacgcgggcgctttttttgttattcagatttttcgcctttcagcaggcacataaaaatgataatcaggataaaagcaatcagggccaggaatggaatcgtaataaaaccaaaccagttaatatattggcccgagcacggcacgccgcttacacacggcttaatgccgctaaaaccgggcactttttgttctaagtaatgcatggttgaaatgaatgcccctataatcgccatcgggagcacatattttttcactcgtgtgtccccttgaaaggtggcgatgcctaaaatcagaacgagcggatacatgaggatacgctggtaccagcacagttcacatggaataaactttctgatttcactgaaatacaggctgcccagcatagcgataagagccacaacccaggaagcatataaaaatacgattctatttttcatatcgttacttccctttcagctctttttctattgtctctttgatttcatcataatccgcaaaatttttgatcactttatcattgacgtaaattgtcggtgttgcctgtatgttcattttttgattaaggtcagaatccttttccacttgagaagcgaatgtttccttatcaagattttccttgagcgtctcaggttttatctttgtggtgctttttgcaagatcaccaaggaggcctggggttacccattcctgttccgtatccggctgtttttcgaacagcttttcatggaaatcccagaaagagtcagggtcttccttccatacttcttcagatgcaagagccgctaatcttgaaccttttccatggaacatgacgttcacgaaagaaaatttcacatcgcccttatcaataaagtctttttgtatttttggaaagatgtcactgttaaacaccttgcaagacggacatttgtaatctccgaattctactacagttaccggtgcatcgtccttgccaagcacaggctgccctttgatagacggctgtccggaaaccgcatcattgccttgttccgttttgttattaatgatgacaatggctgctagcaatacaacaaccacaaccgtaaggatgaccgcgaatttcgcagaagactgctgtttctttttcactccgacacctcatcgttttaaaattaaaaaagaagcggatcgcaattgatccacttctttattttaacaagacaagcgccgataagaaaaccccgaaaaaatgaattctctccgacaatttatttgtttttgagacgcatgacgcgcatagcgtttgccacagcgagcagtgtaacaccgacatctgagaaaaccgcttcccacatggttgcaattccaaatgctccaagaatgagaaagatcgctttcacacctaaagcaaagccgatgttttgccacacgattcgccgtgtccgtttcgcaatccgaatcgcttctgctatttttgacggctgatctgtcatcagcacgatgtctgcggcttctaccgcggcgtctgacccaaggcctcccatcgcaacccctatatctgcgcgtgcaagcaccggcgtatcattgatgccgtcaccgacaaaaatgagtttttcactaggcaaaagcttagcttctaatgcttcgacctgcgccactttatcttgcggcagcagctctgcatatacctcaccaatcccaagctgttttccgacggcttctcccgtttgtttcgaatcacccgtcagcatagctgtctgtttgatcccaagcgactttagatcagcaaccgcctgtgctgcgtcttcctttacttcatccgctatgatgattgctccggcatagcgttgatcaacagcaacgtgtacgattgttccagcattttcatccgggacatcctcaatttgttctctttccatgagctttttattcccggcaaggatctcagttccatttacctttgcaaaaatgccgtggccggggatttcttcgtatgactctatctcatcggaggaaagcattttcccgtaagctttacgcacagattcagcaatcggatgctgtgaatgaagctcagcgtatgccgccgcttcaagtaatctatcctttgtaaaaccttccgcgggtttgatttctgtcacttcaaagctgccttttgttagtgttcccgttttatcaaacaccgcgtatttgacttgattcaaagcttctaaataattgcttccctttacaagcactccggcctttgaggccgctccgattccgccgaagaaaccgagcggaatggagacaacaagcgcacaaggacaagaaatcactaaaaagataagcgcgcggtacacccaatcggaaagcgcggcgccagaaagaacaagcggcggaacaaaggccagcaataccgcgatgatcacaacagcaggtgtataatacttggcaaacttcgtgataaagttttctgtccgggctttacggctgctcgcattctgaaccaagtctaatatttttgatactgctgattcttgatagccctttgtgacttcaatatgcagaacgccgttttgattgataaagcctgacattacatcttgtcctaccgcagcttttctcggaacggactcacctgttaaagcagatgtatcaaccatcgctgacccttgcacgaccttaccgtccaggggtatgctttctcccggattaaccacaatgatgtctcctgtctgaacgtcctccggggaaacctgttcgatgctgttctttgttttgagattggcgtaatcaggccgtatgtccattaacacactaattgattttctggaacggctgaccgcggcaccttgaaaaagctcaccgatttgataaaacagcataacggcgacgccctcagggtattgctgaatcagaaaggcgccgattgtggcaagagccattaagaaatgctcatcaaacacctgaccgcggatgatgtttttgactgcgcggatcataatgtcaccgccgatgatcaaataagcagcgaggaaaaggaaaagttcaatggttcccgaatgaaccaaatatgccgctgcgccgagaatgacagccgccgccattctgatcagcatattgaccattctattacgatagccatcatcagctgatttctttttatgcttttggcgaaccgttacatgcggatcaattgatttcacttttttctctactttattcgtgacccattgctcttctttcccatcggctgagacagttaaggtgcttgccgcaaaatttaccgcgcatccgtcaatgccttttatgcctttgactccattttcgattttttgggcacaattgctgcaatccaaaccgtccagaacgtattcctgtttcactagtctcaccttaccttccgatttagggttcccacttcaaagcgtatcaatgagtattgcattctttataatatatatgagcatatactcatataatagttacacctattatatgttgttttccaagaaagtgtcaatgaaaaacaaaaaccggcatatagccggtttttcattttactttttgcagacgaagagcattcagaacaacggaaacggagctgaatgccattgctgctcctgctatccacggtgctaaaaatccaagtgctgcgattgggatgccgaggctgttatagccaagcgcccagaataagttttgtttaatgtttttcattgtcaatctgctcatgcggattgcgtcggcaatgctgttcagatcgccgcgaataagtgtaatgtctgctgtttccatggcaatgtccgttccagttccaatcgccatgccgatgtcagctgtggcaagcgccggcgcatcgttaattccgtcgcctaccattgccgtctggcggccttctttttgtaggcgggcgatttctgctgccttttgttcaggaaggacttccgcaatgatattcgtaattcccgcttccttcgcaatggcttctgcagttctgcgattgtctcctgtcatcatgatgacatcaaggcccaattctttcagacgggcaacagccttccgcgacgtgtccttaatcgtatctgcaaccgctactagcccagctgcttctccatcaatggatacaagcataactgtttttccttctgcctctagctcttccattttggcgagaagagccccatgctcaacctgtttgctctccattaattttcttgtgccgacgaggatgctttttcctccagcttcagccaaaatgcctgcgccgacttttgcttcaaagcgggtaagcttcggtatctcaagccctttatctttcacgccagcaataatcgcttcgccaagcggatgctctgatcccgtttccgctgccgctgcaaattgaagcaaatctttttcttcaaaatggccgaatggaatggcatctgtcagacgcggcttcccgtttgtcacggttccggttttatcaagaacaattgtatcgagacgatgtgttttttctaaatgctcgccgcctttaaataaaatcccgaattcagcagcgcgtccagatccagccattatgctcgtcggagtggcaagaccgagggcgcaaggacaggcaatgacaagaaccgcaatgaacttgctgatcgcttcggcaaaatcgccaggagccgcccaaagataccaaatgagaaaagtgagaacggcaatccccaatacaatgggaacaaaaatacctgaaatctggtcagcgagacgctggatcggcgcttttgacccttgtgcttcctcaacaattttgatgatatgagaaagcgcagtatcctttccgacgttgacagctttaattttcagaaagccgtttgcgttaacggttgaacctgtcacgctgtcaccaggatttttgtcaacaggaagactttctcctgtaatcatcgattcgtcaaccgctgagcggccttcaaccacttctccgtcgacaggaattcgttcgccaggtttgacgtaaacaatgtcattaacaagcacttcgtcgatcgggatgatttgctcctgtccgtctcttacaacagtagctgttttcgcttgaagcttcatcagctttttaatcgcatccgaggaacggccttttgcttttgtttcaaacaacttgcctaataaaatcagcgtcagcaaaatcgcgcttgtttcatagtaaaggccgtctgtatgcccgtgagagccaaggctttgaaaagtaagataaagactataagcgtaagcagccgtcgtaccgagggcgaccaatacatccatattggcgcttttatttctgagcgccttatatgcacccacataaaacggccagccgatcagaaattggactggtgtcgccagcgcaaattgcatccacggattgagaaatatatccggtacccaaatgaatgatgtaaatgtaaaatggctcaccatcgcccaaagcaatggaaatgacaggacagctgaaaaaatcagtctcgccgtttgcttcctttcttctttctttttagcagcagcagcctcactgtcctgttcacccttcaactttagcttatatccaagcttatttaccgcttctttcaaatcgctgacagacgcttctttcggattgtattcgaccgtaactgtttctaaagcgaagtttactggagcatttgcgacgccttctattttgttaagccgtttttcaatccgattggagcaagccgcacaggtcatgccttcaatatcgaattcagctttttctgtaacgacgtgatagcccagcttttctattttttcttgaatcgctgcagtccctgtttcagcaggatcgtagattacatttgatgtttccgtcgccagattaacatttgcatccgtgacaccgggcatccgcttcagtcctttttcaattctggcagcacatgccgcacaggtcataccagagacctgcatcgcgatttccttttgttcactcaacatactcactcctttatatacacctggggggtatataaaaatgaaagaaatatcgcgcctccctataggcgcgataccttgaatcactcagctacgtcatagccctgatcttctatcgcatccgcaatatctttgactgatactttgtcagcatcaaacgaaacatcgactttacccgcttccagattgacatgaacggcactgacgccgtccagttctcctacgcttgtttctactgctttgacgcagtgctgacaagacattccttcaacttgcaatgttttttgttccataatcaattcctcctgtttattctttctattttcatcctaccatacccctgtagggtattacaataaaaaaacgctttatgattttgtgaactttttaaatacgtccaaaagctcagaaatggcctgttccccgtctccgcttttgatggcatctgctacacaatgatgggcatgatcctcaagcaaatgaagcgccacatttttcattgccgcctgaacagctgaaatttgcacaagaatatctacacaatatctgtcgttttccaccatgttttgaatgcctctgacctggccctcaatccgcttaagccggtttgtaatctgatccttttctttcgagcttttatggtttaatgttttatgttcgttatgcttttccatgcgtacacctctgtttaatgatattaattcccattatactgattgtccaaacggttgtctaagcatgccgatccaaaaaatgaatcagttaggttttaccatttgatcaggagggtatatacttctgttgataacgcttttaaaggggagaagaaaagtggacacgatcaaggttggaatattaggatacggattgtccggttctgtttttcacgggccgctgctggatgttctggatgaatatcaaatcagcaaaatcatgacatctcggacagaagaagtgaaacgggactttccagatgctgaggttgtacatgagcttgaggaaatcacaaatgaccctgccattgagcttgtcattgtcaccaccccgagcggccttcattacgagcatgctatggcatgcatacaggccggaaaacatgttgtgatggaaaaaccaatgacagcaacggccgaagagggggaaacattaaaaagggctgccgatgaaaaaggcgtattattaagcgtatatcataaccgacgctgggataacgactttttaacgattaaaaagctgatctctgagggatctcttgaagatatcaatacatatcaagtttcctatgaccgctacagacctgaagttcaagcgcggtggcgggaaaaagaaggcactgccactggtacgctgtatgatctcggctcccacatcatagaccaaaccctgcatttgtttgggatgcctaaagccgtgactgcaaacgtgatggcccagcgggaaaatgctgaaacggttgactattttcatttaaccctggactatggcaagcttcaagccattctatacggaggatcaatcgttccggcaaacggacctcgttatcaaatccatggaaaagattccagctttatcaaatatggaattgacggacaggaagacgcactcagagcgggaagaaaaccagaggatgacagctggggtgcggatgatccggagttttacggacagcttacaaccattcgtggctccgacaaaaaaacagaaacgatcccatcagtaaatggctcctaccttacttattaccgcaaaatagcggaaagcatacgggaaggtgctgcgctgccagtcactgctgaggaaggtattaatgtcatccgcatcattgaagccgcgatgaaaagcagtaaagagaaacgaaccattatgctggagcaataaaacaaaagcctccccaagtaaggggaggctttttcattagaatgtttttcctgcttctttcgcacgcgcaatcgcgtcttctttgatttgctgtgctttatcaggctccgcattatgtccctctacgaaaatgccatcgaaggatggtacgccgaaaaaattcatcatgatgccgatgtagcggtgtcccatttccatctcagccgcagggccttctgaatagtagccgccgcgcgcttggatatgaattgcttttttatcagttaacaagccgacaggaccttgttctgtgtatttgaatgattttcctgcaacagcaacagaatcgagatacgctttcatcactggcgggaatgagaagttccataaaggagtaacaaatacgtacttatcagctgatgcaaattgatcgctaagctctcccaaacggcctactttcgctttttcgctttcagaaagctcttcaaagcctgtacctgactgaagctttccccatccgctaaatacatctgcgtcaatgtgcgggatgttttctttgtacaaatcgatatgtacaacttcatcatttggattcgcttctttgtaagattcgataaatgctttacctgttgccatactgtacgaagttgcttcgtcatgcggatgagcagtgatatataatacttttgccatttttaccagccctttcgtttttaaaaatcacacatcaattattatcatacagatgcataatgattattctgtctctcttagactttattataaagacaaagaaatttactttcaagtaaaatatctcgaattaaagattatttaactttcccaaacagcttacttttcaaaagctgttctcaagccggaatacagcgcggacagttctttactgattcgaggataatgagggacatgcggcacttgaatatccgcaggcatccttttcactataaaggattgctcagccttttcaaaaaacgcccccagctggttgatctcttcatcagaaaacggagcaggcggacggcggtgagcttgggccgaaagcaaatagtaccctaagtgctgagcaccggaaatggcaggccagagcgcatccgcattcgcgtgaggaaactcgccaagcgccttgtcatacgcatcccgaagcctgacaagactcacccttaacttgtgttcgtcggcaatttgcccggttaacagtttctccataaactgcccttccagccggatgacattccgcacaagttctggcagccgcttggttgaaaaccgccgccacaaaagcattgttcccaacagcccgatcacgctgccgacagctacatcagtcagcctcgctatcataaaataaccggcacccgcgccgccatgcatactttctgtgataacaagcgcatttgcggttaaaaagggaacagccagcgcataattgcggacgatcagcatctcaagaagacattgcagcgctgcaatacaaaacgcaatataaacaccgcccagcttaaaaaacaggattgcacctgccagcataacaccgatcaccgttccggccgaacgctgaatagccctgtgaagcgtaaaaacaacagtagtgccaagcatgaccgctgctgccgaaagcggaatccaataggagcgtgcaaagccgaatgcgagggcaaacatatcggcggcaaacagaacaattccgtactttaacgctctaatcaaaactggagacttccagtcaaaagcatttctcaaaaagtaaaaagaggatggcaggcggcttggttccccgtcaagctgcttatcaaaacgtcctgaagcgatatgcaaaacctcattgatttcttcaaacagcttccgcctaggctcagattcgttctcattaatctgaaacgtaccgaaaacccgtgcatgcgcaagcatatctccggtttggcgaagtgccttttcaatctgcgcggtctctctgtccggcgtttcagctgaaaaatgaataatggcaatgaatatgtcgtcagctttttcaagcaggcggaaaaaccgttcatcatgccgcgattttttccgtttattccctttcccaagaaccgtttgtcgggctgttctaagcatgagcaccgtctgatgctgtgcgttatgaaaacctggcgttccgacggctgaaagacatgcagccagctgatgatatgttttttgcagcaccgctccctccggtccatgtttgttccataaccagccgattaaagcgatacccatggcgaaaatgccgccgagaaacgtcagtcccgctctgaacagcgcttgtgaaggatcggccggcagcccggaactgactaaaaaggcaaggacaaaaaacatcggcgcagggccttgaatgccgagcgcgctaaaaataaacatcgccgctgcaccgatcagccccaaaacagccgccatcatccaaagcatcccggacaaaagtgtccctaaaccaaatgagagggcgatcccaatagaaaccaagagcagcttcaaggcgcgctttttgtacgattcaccgcccgcatataaataaacaaagcctccgatacttgcaattaatccgtaatccgtgtgacctgccaatgcaccgaccagcacaggaaaccctgaagcgaaacctgatccgatagcctttttccaaggaaatggatttgcatgaatgcgaaaggcatccttcacgataggcatgattctttgattgttcgcagcagttttgttcatttgacaaaatccttttcaatgaatgtgtagaacttttcccgtttcttcgctttagtatgcccaaaaacgcggttagcttctcaattggtgcgcccgataaaaaaacagagacttataccgtctctgcttcattacatcagtttattataaaagcggcacctgtcaggactgttttgtccttctgccttccttcaagagcaggtgaataaaaaataaaggataaatcaatagatacccattaaacagccaccacacaagatcaaagtcactgctgaatgtccagaatgatagcgcctgcagacctgaacaacaggtcagcacaagagaaatcagcgccatcagcttccagtcagctcgattcacccgctgtaggtacaagctgtacaaccctgtgacagaaatcaggatatccagcggaaaaaaagaccagttccaagcgatcataaacggatggtcatgatgtttaaaagcccagctttccggtatgagagaaaacccggctgacagccagtacaagataaaaccgatatcagtcacgagaaaaaacagcttcatatatctcatttgtactgcccgcttttatgtaccggctcagacaccgcagcatgctcgatcaggtttaaagacacaacaccggcaataatcaaaccaattgaaatgactttcatgacactaacatgttcttgaaaaaacaaaaaaccaatgactgtaatcaggacgattcccatccctgaccatacagcataagcaacagatacatctattgattttagcgtaagcgtcagaaagaaaagactccctccataaaagaaaatcaacagcaaactgggaataagctttgtaaaaccagacgatagcttcatgctgaccgttcccgcaacttcaaacaaaatcgccaagcatagaaacacccaattcatgtcgcatcagcctcctcatcagctgttataccgttaaacaaaacatctacaattgattcaagcacctctcctgtcatgaactgatgtttcagcggatattcagggtcatacacttgattgatgctccctatatacatgtgaacaaacaggtccggattgatgtttctaattctcttttgctgtttgcactcgtctaataattctaggacaatggcccattctgccttaataaacgtgtctaatgtaagccacgcatcgtaatggtatttctttagttcatttaataatcccatgttcagcagttccatcccctgcggaaggctgatcagcatttttttcaccttttcaagcacatttaaactttcattttcatagatgtctctttctatttgcttcatttcagctataaattgttcgacaaccgcctcaacaagctgatctttagatgaataatatgcatagagagtccgcttgctcgttcccagcgctgccgccaaatcattcatcgtaaatgaaaatcctttctgcttgatcagccggaaggtttccgccagaattcttttatccatattaatcccccgctttcggtaccaagaaaactatttcggtaccaatattatacggcagaaatttatggaaagcaacaatatataaaaaaacctctcctattgggagaggtttaaaagacactgcggaccaaaccgccgtccgcccgaagtgccgcgccattgatcgcagaggaaagcggactgcttaaaaatgtaacaaagtgggcgatttcttccggacggatcagtctttgaataatagatgtcggccggttttctttcataaaacgtgcctcagcttcttgaacagtcaggttttcaccaggatacagcgagttcagcatggtttccacaccctctgttaaggtagagcccggcatgacggtgttgactgtgacattcgtgccggttgccagctccgccaaactgcgggaaatggacagctgcatcgtttttgtcgcactgtaatgcgccatttcctgtgacggcataatcgccgcttcactggcaatgaaaatcacacgcccttcctttttctctatcatgttatgcaaatacctgcgtgtcagccttacaccgctcataatattcacttcaaaaaaacgaaaccattcatcgtcgggaatatcaaaatactccgccggttcaaaaatccctaaattgttgaccaaaatatcaacctctggatatgcctgaaacagctcattgcagccttcttctgttcccaaatcaaatgcagccggataaagaaccgcttcagcatgttgtgttttcagttcatctatcgtctgattcactttctcttcccggcgtccgttaatgatcactgccgcaccttcttcagctaacgaagaggcaatagcttttccgatcccagatgtcgaaccggtcaccagtgcggtttttccttgtaaattcagcttcattattcatccctccgtttttgattcctcttatttattgacagaaatctgattggtgaaacatctgctctgcaatcagtatgaaacagctgggattgaaatggaagtacgcactttttggtgcctgtggtttggagaaaaaataaagcagaaccctctaagaggttctgctttattgtcagtatgtatggagacggtgggagtcgaacccacgtccagaaacatcgattacttaagcgtctacgagcgtagcctgcatatttatggtttcactcatcttcttgcctgcgggcgggccttccgagagctagtctgttcatctcttcttacgttctcagacaggaacgcaagcgtagcctacttggatgtgctcttcacagacacataggcaatgtcaggaagagctcgctgcgcttattaggcagctaatgctacgttttggttaaaactgttagttttgccagttatatttaagtgcgtttttacgagatcgcctctcggctcgcagctcaagctcgatccatccctgtcgaatccgtaacgtccccttggtataagggaaatacgggagaaaatatcaagctctcactcaaactggctatagtcttattataacatgatcacggctcttttcaattgtcaaatccttcaaatgaatggcgtcgtgatctgatcgtgaacacagtatagcacaggcctgattttcgaatcaagcactatgcctttagaagcctttttgactgtctctgaacgctctttcgatttcccgcttcgcgtccttgcgcttcaggtcttcccgtttgtcatagttcttcttcccttttccaaggccgagaagcactttcgcaaagccgttttttaaatacagcttcagcggaacgagagaatagcctttttcctttgttaacccgatcagcttattaatctccttgcggtgcattaacagctttcttgtccggagcggatcgtggttatagcggtttccctgctcatatgggctgacgtgcatattgtggagaaacacttctccccgttcgattttggcgaaggaatctttaaggtttacgcggccggcgcgaatcgatttgatttcggttccttgcagaacgatgcctgtttcataggtttcttctataaaataatcgtggttggctttcttattttgagataatacttttcctgacccttttggcatgccagaacctcctctctctaaggaaaaactgtccaccttttgcgatacgctctattttaccaaatgtcacgtaccgctacaatgaaaagctgtttccgaaagaaagcaaatagagcgctgcggccctatttgctggttgagctgctatttcttctttttccgtttctgtttcggagcattctggaagccgcgttttttctttttcttcttcggcttagtgaaccactcccctttttcctcagacggagctggagaaacaggtgtattggtgctttgaacacgttttctggcaggctttccgcgttttctgctccggctgctgtccaattctctcggacgccgcggagtgcccttcatgccgacaatttcaaagtcgatattgcgctcatctttattgacatcgacaaccttgactgtgatttcatccccgatgcggaagacgttgcctgtccgctcgccaatcattgcgaaatgctgttcgtcaaagcggtagtagtcatctgtcataaagctgacatggacgagtccttcaattgtattcggcagctcgacgaacattccgaagtttgtcacagagctgatcatgccgtcaaactcttcaccgattttatcaagcatgtattccgcttttttcaggtcatccgtctcacgctcggcgtcaactgcacggcgctccatagatgatgtatgttcggcgatatccggcaggcgttcagcccacttttcctgtgtcgcttcatcgactttgccgttgatcaaatacgttcggatcagacggtgaacgattaagtccgggtaacggcggatcggcgatgtgaaatgcgtatagaattccgttgacagaccgaagtgccccaagctttgcgggtcgtatttcgcctgtttcatcgaacggagcataacagtagatataaccgtttcctctggtctgtcacgtacagcgtccagaatgctttgcagcgcgcgcggatgaatattccccgccgttcctttcaccacatagccaaatgtcgtcacaaattctaaaaacttttgcagcttttcagcattcggctcttcgtgaatccggtatataaacgggacgttcatccaatggaaatgctccgccactgtttcgtttgccacaagcataaattcttcaatcagcttctcggcgacagagcgttctctgatcacaacgtctttaaccgctccttcgtcatcaacaagcacctttgcttctttgaaatcaaagtcaacggcgccgcggtccatccgcttatcgcgaagaatttgagccaggcgctccatgtctttgaacatcggaacaagaggctcgtatttttgcttcagctcttcatcatcatcaacaagaattttattcacatctgaatatgtcattctttccgttgttttgatgacactttggaagatctcgtgctctgtcacctgtccctgactgttaattgtcatttcacaagaaagcgtcaggcggtcaacctttggatttaaggagcagatgccgtttgacaatctgtgcggaatcatcgggatgacacggtcaaccagatacacacttgtccctctttcaagcgcttctttgtcaatcggcgagttttcggttacgtaatggctgacatcagctatgtgaacgccaagcttgtagcttccatcatcaagtttcgtcacggtaactgcatcatccaaatccttcgcatccgcaccatcaatggtgacaatcacctggtcacggagatcacggcggtctttcagatctttttcatcaatcgtgtcaggcgtacttgatgcctgttccatcgcgtcagctggaaattctcccggcaggccgtgcttatgaatgaccgataaaatatcaatgcctgggtcgtttttgtggccgagaatggtttcaacctcaccctctgcgttcatgcggccttcaggatagctcgtcagcttgacaacaaccttatgcccttccgcagctccatttttcccatttttcggaatgaagatgtcactcgtgatttttttgtcgtccggaatgacaaagccgaagtttctcgtttctgtatacgtgccgacaacccgctgaatcgctctttctaaaatccgtatgacggttccttcctgcctggagccgcttgactgtgaatttagacgcaccatgacgatatcgccgttcattgccgtatttagctcattaggcggaataaacacatcacttaacgacgtatcctcaggcagcaaaaaggcgaatcctttcgcatgggctgaaatctttccttttattaagttcatcttctccggaatgccgtagcggtcgcttctcgtccgtacgataagccctttttcttccaaggcgactaacgctttgacgagctctttaaactcctcggcttccgtaatatttaacatctcctcaagttcctgaacggtcagaggtttgtacgcctcttccttcataaacgagagaagcttttccataaatgcttctttttccattatccgacctcctgttgattaccaatcgagcttctctaaaaattcatacacatcctgatggacgaggtcacgttctttgtcgagtgtaatgacatgccctgattcctcgtaccatttcagctgtttatcatcagtttccacttcgttgtaaataatattggcgctttcggtattaatcatgtggtcatgacgggcctgcaccacaaatgtcggtgaataaatcatatcgacattattccgcacatcagcaattaagtcttgtagcgccttgagggtattcatcggcgttttttcgaattctttcatttcctcttcaatttgctccgggcttttcccctcaaactttttgtaattgcgagcgtatgaaagaacgccttgatacatgacctcttcactcttaatatgcatcggtgcgcacattgggacaattccctttatgggtacagtgtaacccaatttcagcgaaaaaaccccgccaagcgacagtccgcaggcagcaatgctctcatagccttcagattttaagtattcatagccatccattacgtttttccaccagtcttcgggccccgtatgtacaagttcttcaggcgggacgccatgtccttcatattgaggcgcgtggcacgtatagccgcgttcattcaaatatcgtcccagcatccttacatccgctgtattgcctgtaaagccgtgcagcaaaagcaccgctttgtctccgcctttaaatgtaaatggttttggtgtcacaactttcatgctcatgtctccctttctatctgcacgatcattttagttttccacagtttaatcagaaaaaaacgttttgaatatcatccagaaacgtgaaaaaggcctgacttcacatcagaccttatacaaacattgccctataggatataagcaagcgcaatcgttaacacgaaaaacaagactgccagcactaccgtaatgcggtgcaaaattaaatcaagacctcttgctttttgtttcccgaagagctgctccgctccgcctgaaatcgcaccagataatccggcgcttttactggattgaagcaaaacgacaataataagtgcaatgctgacgataaccaataaggtaatcaaaactgcgtgcatcccatacacctccagactcactggctacattacttctattttacatgaaaagggttggcatgtcacgctgtatcagacgccaaaaggccggataagacgttttatcttggttaccctattcatatgaaaaggacaaaggagaaaagcgatgccgcttatcagcatagacagcaggaaacatcttttttatgaagaatatggacagggaatccctatcatttttatccacccgccgggcatgggacgcaaggttttttattatcagcgccttctatccaagcatttcagggtgatttttcccgatttaagcggccacggtgatagtgatcatatcgatcagccagcgtctatttcctattacgcaaacgagatcgcgcaattcatggacgctttggatattgataaagctgtgttattcgggtattctgccggaggcttaatcgcgcagcataccggcttcacccgccccgacaaagtgtcacaccttattctgtccggcgcctaccccgctgttcataacgtaatcggccagaagctgcacaaactgggaatgtatctgcttgaaaaaaaccccggtttgctcatgaaaatcctcgctggcagccacacaaaagacagacagcttcgcagcatattaacagaccatatgaaaaaagcagacctggcccattggcatcagtattatctggattcgcttggctacagctgcattgaacagctgccccgcctagaaatgccaatgctgtttatgtatggcggcctgcgggactggacctttacaaacgcaggctattaccgaagatcgtgcagacatgccgaatttttcagattggaatatcagggacatcaattgccgacaaaacaatggaaaacgtgcaatgagctggtgacacggtttgtgctgacacatcattcaatatagaaaacgttggatctccttgcgttttctatattttattgacttttgtcaacaaaatcatagtaaaaaagatcctcaaatttcaaattaaaatagtgaagcattttaccgatcacaagctgccccggccgtctttctccattcagcacgcggctcagtgtggcgggtgagactccgatttccagcgcaagctgattaagggaataatcgttattaaccatatactgcaagacataatcacgtctaatctgtatcttttctactggcactttcctcaccttccattcctgaaaaacttttttctatacttttacattacggcttatgttaacttttgtcaatacatttccagtctacctattccctttagtcaataaacatactaaaatatgagtaacagtgagggacggggtgagatatatggaaagctttggcgaacaattacgggcattgcgtgaagagagaaagttaacagtcaaccagctggcgacttattcaggcgtaagcgcggccggcatctccagaatcgaaaacggaaaacggggcgttcccaaacctgccaccatcaaaaaactggcagaggccttaaaaattccttatgaggggcttatgtacaaggctggttacatcgaagaagtgcatgaagccagggccccttacgaaacgaagtgcaagctgcttgaaaaagcggaggcctatgacctgaaaaaccttgcgcttcttgagaacgaaaagtggcaatatctcaataaagaagatttgctcatgctggatcattatttttcgtttatttcagacgaagccaaaaaacggtctgctgatgactgactcttgatagaaatgtgaggcgatagaccatgtcaccgttcggacagcaattacgggagctgcgccgcgcccgcaaactgacagtgaatcagcttgcggtgtactcaggcatcagctcggccaccatttcaaaaattgaaaacggcaaacgcgggacgccaaaacccgccacgattaaaaaactggcagccgtcctgaaagtgccgtacgaaaacctaatggccgccgcaggccatattcaggcctttcctgaagaaatccgcgaagcatctgaaagctatcaatccgtttatgaaatttaccagacggctgtcactcgcggagcggagcacctcccgattttcaatagtcaaaaatgggaacatctctcaaagcaggatattgaaaatctcagcaaatacttcgattttttgtcttcagaagcaaaaaaacgcgcctcttcctcataatcccctgtttctctttctatattttatcaatcacgcttgcataccctccctcgttatttgcgttataatagtgacagacgaggtgaaaagtatgaaccaatcagaaatgtgtcctagatttgaaaaagcagtcgacatcttaagtaaacgctgggtcgctttaatcgtatttcagctcttgaacgggtctcagcgatttagcgaaattgaagcagcacttccaaatctaagcggcagagttctgtcagaacggctgaaagaacttgagcttgaaggagtagtgaagcgggatgtcatccctgaaactccggttcgcatcgaatattcattgactgataaaggaaaggcactagcacccattttaggtgagatttctaaatgggcgactgaatggattgacccttcctttcttgactaattgctaaaacggctctgatctcaaagatgagaaaagagccgttttttattttttcccaggtgaaaaaacgatttctcagccgatatatagtacatccacacattacgtttttaaaggagaccactatatgcgactgacgatttcccgcaaattcagcctggtatttttgacactgatcctgatcaatttacttgtaggcggaataggcgttcttaatatgcagcatatcattcaaaaaacagatgaaatcaacacaaaatggattgacggcatcaaaggaatcacttcaattaattatgtaaccgagcacctgtcttctaaagaaaaggactttctgatttatacagacaaaagcaaaatggatacacttgatcaagaaatgaatcaaatcatggaagacattaaccaaaagctcgataactacgaaaaaacgatctccactgataaagagcagaaactgttcgagcagcttcaaactgaagtgaatacctatatggatattcatgcgcaaattatcgaaagcggccgcacgaatgacatggacaaagcaagaggtttattggttcagactgaggccagctttgaggatatgaaaaaaacaatcactcagcttgttgacttaaatcaagaaggcagcaacacagcggtaaaagaaacgaaggccgtctatcataaagggctcatttacactgctttgcttgtggcagcttcgatcctcatcagcattttcatctggctttatatcacgcgaaacattgtaaagcctatcattcgcatgaaggaatctgccaatcatattgccgaaggcgatctgtcgaacgatatggagccgctcaactcaaaagacgagctgggtgatctgaatgaagcgctgcaaaaaatggtagggaatctgagagatattgtcggatattctaaagacatatcaagccgggttctttcttcttcacaggtgcttgcaaccgcaacgaatgaaacaagatccggcagcaaacatattaccgagacgatgaacgaaatggctgagggctctgaacagcaggcccaagacgccgtgacgattgccgaatcgatgaatgagttcactgaaagcattgataaagcctataatcacggcatcaccatcagcgatacgtctcaaaacgttctcgaactcgcggtaagcggaaacgaaaatatggctacgtcattacagcaaatgaaaaccatccatcatattgttgaagaagccgtgcataaagtgagatcactggaacagcattctcaggatatcaacaagctcgttcaagtcatcaacggaattgccgagcaaacgaatttgctgtcccttaacgccgcaattgaagctgcccgcgcaggagaaagcggcaaaggcttcgccgttgtggctgatgaagtcagaaagctggctgacggcgtttctgattccgtgcaggacattacccggattgtaaacgggacacagcaggagatccacactgtcattacgtacttggaaagcagctttacagaagtcgaaaaaggaacggaaaacctgacagacaccggacaggctatgcagcatatcaaacaatccgtcacccatgttgcagacagcattaaggaagtaacggatggcctgaagcagttaacaaaccaatcgattaccatcaatcaatcgattgaaaatatcgcttctgtatccgaagagtctgccgccggcattgaagaaacattttcaattaccgagcaatccgcccattcgatggatcaagtgcttctaaatgctgaagagcttgagcagctggccaatgagcttaatgagaagatgggtcagtttacgatttaaatagaaaaaagaggctggactccagcctctttttctattctatgcagctgattgaacatgtttcgccccggttctttttttcttcaccggacttaatgcccgctccagccaagccatgagcaaatccgcccctaccgccatcaccgcagttggtatcgctccggctagaataatcgcagttccgtttgttgcgtttgagccgcggacaatcatgtccccaaggcctccggcaccgacaaatgtgccgatcgctgtaattccgatggcaatgacgagagccgtgcgaaggcccgccataatgacagaaagtgcgagcgggagctcaaccattctgagtacttggaatttcgtcatgcccattgcttttcccgattctaagtaggcatgttcaatactgataatgcctgtgtacgtgtttcgaataatcggcagcagggaatacagaaataatgatagaatcacggtatttgcgccgagccccataacaagcattaagacggccagcatagcgagcgccgggattgtttgaataacgtttgttacggcaaacacccaggctgacaaacggcgaaaatgcgcgatgaggattccggccggaaccccgacgacagcggcaaataaaacgccgtaagccgacatgagaaagtggcggccgaattcatccatgacgtaactgccattctgcgcgtaatacgtcattaactgttcaagcacgttcattgacctcttccccctttcacgattcgaagtagtgatgtttttctaaatattccttggcaacgacagacggttctttgagattgccgtcgacttcatagttaagctcctgcatcgtggttgtgtcgatttttccgagcattttcttgatgatgccttcaagctcaggatgttctttgagcaccttttccggaacaaccggagagcagtcgtacggcgggaaaaattgtttatcatcctttagcattttgagaccataggacttgattcttccatcggttgaatacgcaagcacaatgtccatttttccgcttttcaccgcgtcgtacacaaggccgatctgcatcggatacgtgccgccgaatgtcatgccgtaggttttcgtaaaatcctgatagccgtttcctttgagcttcatccaatagttatcaacgcccagctttaattgcggcgcccattttttaacgtctgatacggtctctaaatggtattggtcggccagttccttgctgactgtaaaggcatatgtattatcaaacccgtaggagttataccattttaaattgtatctttttttaaactcccgctgagtaagcgccagcgctttgtccggatctttttcaggttccattctcaacgtgcctgtcagcgcgtctcccgtatatcttgtggccgcaatgtcaatttccccgttcattaaagcctgctgctgcaccgcgttggagccaagatttttaatcgttgttgttttgagatcagtatggtgttcgatcaactggccaagcatactagcgatgatttctgattcgctcatgctttgcgcgccgattttaatggtctggtctgcagcagcgctgagaccaggaagcgaacagccgctcagcgtcagcgttgccgcaagtgctaaacctatgattaatttgaggtattttcttttcatgagccccctccttatgacaattcattcaatctctgcatgccggcaggtgtcagttttcgttcagcaactgcaagcacataatcaatcacaattgccaatatcgtgacaggtaccgcgcccccgatgatatattccggctgatataaattcagtccgataaaaatgtaatcacccaatccgccgcctccgataaaggaagcaagcgtggcccagccgattaagtaaatcgtcgatgtcctgattcccgccatgatcactggcgcggcaagcggcagctccaccaagcggacttgttcagccggcgtcattccgattcctttaccagactcgagcagatttttgttgacgccgcgaatgccggtatacgtgttgcgaagaatcggcaatacggaatagaaaaacaaagccacaatggccggaaccttccctacaccaaggagcgggataaaaaaagcgaggatggccagactcggcagcgtctgaataatattgacaatgccgataatggtgccggctccttttttcattctggtaagcacaaccccgagggggacggcaaccagcacgcctaagatcacagcaatgagcgatatcgtaatatgctcgtatgttttataaagaagctcgcccccattggtttgcaaaaattgaacaatatgatgcatgacttatcgcccctccctatgacaatgctgcgagctgcttttcttctccccagagggagtcatacacgatgtcgaccagacttgccctcgtcacaattccgatcaggcgtcggtcttcatccacaacgggaacatatttgacaccccgttttaaaattttgcggaccgtgtcgcgcagcagtgtgccgcccagtactgtgtatatatcttcatgtaaaacttcactgacgagattggcctttttccggcattgatcaatgatttcaacatcgacatagccttgcagaccgcgctcgtcatcgacgaccagcaatgaatcgacccgttcctgcctcatcagctgaatggcctcagaaagcgttttatccgcggtgatcgttacaggctgtgtgttcataatctggtcaacccgttcaacatccgggctggatgactgaatcagccgctccttgccgataaattcctcaacaaattcgtctgccggatttcttaaaatgtcatcgggcgttccaacttgaacgatttctcccgcttttaaaatcacaatccggtctgccagcttaatcgcttcatccatatcgtgggtaacaaatacgatggttttatgtaaggttttttgcagttttttaaattcttcctggagggaatccctcgtaatcgggtcgagtgccccaaacggttcatccattaagataagcggcggctccgcggcaagtgcccgtaatacaccaattcgctgctgctgccccccgcttaattcatgagggtaacggtctacatattcaggccccatatcgaccaattttaaaagctcacgcgcccgctctttccgctgctgctccggccatttcagcagttttgggacgagtgagatattctgctgaatggtcatatggggaaacaggccgatctgctgaatcacatagccaattttgcgcctgagctctacaggatcctggtccatgatgttttcgccgtcaatgaaaatcttcccggcggaaggctcaattaatcggttaatcattttcattgttgttgtttttccgcagccgctcggcccgataaagcagataaattcgccttttgcaatcttaagatttacgttgttcacggcttttttgccgcccttgtatgttttcgagacattttctaatgtcagcaaacatcgcacctccaaaattaagtttattcaatttgttcagtttaaatttaatttttcagacaattgaatgcttcccattatagaataaagtttataaaataaaaagtttacaatttgttcatattatttataaagtatgtgtaaacgctgatttacccgcattgacgtgtgttgatctccttattgctccaatttcctgccaaattctcttttgacagcattttcgccgtatcaaaaatgtggtatattgacatcggaattgttagctgaaaggatgaaaccgttggagaaagatccgttaacgatcattgaacaagccgaggaccattttatagaaaaaatcgcggaaaacatgcatgcatttggaatgccctctaccgtcggacgagtgctgggcattatttatatgaatcgaaaaccgatgacgcttacggaattatctgaggccaccggcatgagcaaaacacgcatgagccaggtagtgcgggaaatgcttgatgccaacattgccgagaaggtgttcgaaaaaggcgtgcgaaaagatttatatgaggttgagcaggactactatcaaacatttatcacgctgttttcagccacctggagcaaagtcgtcagcaaaaacaaaatgatgcataaaaaactcaatcgggagctgcttagcgtgttggatgaagagcttactcctgaagcggaagaaaaagtgaatgagctgctgaaggaattaaaggaatggctcgattattataattggctcagccgtttgattgagttttttgagagcgaagaaatttttaaatatgtgccgaagccgtaaaaaacgccctgtcattacaaggcgttttttcttatgcggcacctgccaggtttttcttttttctctttttaatcgggcttaatgctcgttcaagccagcccatgaccaaatcggcaatcaccgccatcagagctgtggggatcgctcccgctaatataatcgcggttccgtttgtggcgtttgatcccctgacgatgatgtccccgagaccgcctgcaccgacaaatgtcccgatggccgtaatgccgatggcaatgacaagcgcggtgcgcaggccggccattatgaccgaaagcgcaagcggaagctcgaccatccgcagcacttgaaattttgtcatccccattgcttttccggattcaagataggcgtgctcaatactgataatccctgtatacgtatttctgataatcggcagaagagaatacagaaataatgacaatatcactgtattagcgcccagccccatgacaagcatcagcacggcaagcatggcgagagccgggatcgtctgaatgacgttcgtgaccgcaaaaacccatccgcttaatcttctgtatctggctatcaggatgccgagcggaattccaacaatggcggcaaataaaacgccgtataccgacatcagaaaatggcggtaaaactcctgcagcacataaccgccgttttgcgaatagtatgtgccaagctgctgtagtacttccatatgatccacctcttttcttagtcaaaataatgatgtttctctaaaaattcctttgctacgacagacggctccttcagcttgccatccacttcataattaagttcctgcatcgtttccgtgtcgatttgcccaatcagcttattgatcacaccttcaagctccggatgcgccttaagcaccttttccggaatcaccggtgaacagtcatacggcgggaagaaacgcttatcatcttttaagattttcaagtcataggctttaatccgtccatccgttgaataagccagaacggcgtccattttcccgtttttgactgcgtcatagacaagcccgatctgcattggataagttgtgccgaattcaaagccatatgtgctgacaaagcctttatacccgtcaccttttcgtttcagccaagcattgtcgacgcctaatttatattgggaggcattttttttcaggtcggacacggtgttaatatgctcattttccgcaaacttttttgttacggtgaaggcatacgtgttatcaaagccgtaggaatcaaaccatttataagaaaagcgcttttgaaactcgttctgcacaatgttcagcgctttttttggatctttctccgcttccttgccgagggtgcttgttaaatctgttccggaatagcgcgtggctgaaatatcaatgtcaccgcccagcatcgcttggtgctgaacatagtttgagccgaggtttttcactaaagcggtattcaaatctgtatcatgttcaataagctgcgcgatcatattcgctaaaatttctgattctgtcatgctttgcgccccgattttgatcgtgtcgtcagaagcgccgccgagacccggcagagagcagccgcctagcagcatgacaaagacgagagcaaacgcgccaagccatttgatttttgtcgttttcaacagagccaactccttacgaaacttccttcatcccttgtaatcctttcggcgtcacctttcgttctgtcacggctaggacataatcaatgataattgccagaattgtgacaggcacggcaccgccaatgatatattcaggctggtataggttcaggccgataaaaatatagtccccgaggccgcctcccccgataaacgacgcaagtgtcgcccagccaattaggtagatcgttgatgtgcggatccccgccatgatgatgggaattgccagcggaatttcaacgagccgaatctgctcccagcctgtcatgccaatccctttccccgattccaggaggtttttatttacacctttaatgccggtatacgtattgcgcaagatcggcagtaccgaatagaaaaataaagcgacaatcgcaggcacttttcctacgccgagaagcggaataaaaaaggctaaaatcgccagactcggcagggtttgcacaatgtttacgaaaccgataaccgcacctgcgccttttttcattctggtaagagcaacgccgagcggcactgcaacgataatgcccaatacaacggctatgagtgaaatatataaatgctctcctgttttatacagcagctctccgccgttcgtttgcaaaaaagtcatcatttgattcatcttaaaagagctcctcccctggtcagatcgtcatgagctggttttcctcgtcgccccaaatggaatcgtacacgatatcaacaaggctcgctcttgtcacaatccctgctaaatggttctgttcatcgacgaccggaacatacttgatcccctgcttcaaaatttttcggactgtatcgcgaagtagcgcccctttttgaacggtatatatatctgagcggtatacatcgccaacgatgctcgcttttttgcggttttgatcaatcatttccacatcaacatagcccttcagcacgttttgccggtccacaacgagcagcgagtcaacacgtttttctctcatcagctgaatcgcctgagaaagcgttttgtccgcagataccgtcaccggcgttctgttcatcatttgctctacccgctcgatatccggtcttgactgaatcaggcgctctttcccgataaattcttcaacaaactcatttgccgggtttcgaagaatctcatcaggtgtgccgacttgaacgatttctcccgcttttaatatcacaatcctgtcggcaagcttaatcgcttcatccatatcgtgggttacaaacacaatcgttttgtttaaggttctctgcagttttttgaattcttcctgaagggaatcacgcgtaatcggatcaagcgctccgaacggttcatccattaaaatgagagggggttccgctgccagggcgcgcagcacgccgattctctgctgctgtccgccgctgagctcatgcggataacggtctaaatactctgggcccatatccacaagctttaacagctcgcgcgcccgttctttccgtttttcctcaggccatttcagcagctttggtacgagtgagatgttctgctggatggtcatatgggggaacaaaccaatctgctgaatcacatagccgatttttctcctcagctcaaccgggtcctgttccataatattttctccgtcgataaagatccttccagacgatggttctatcagtctgttgatcatcttcatcgttgtcgtttttccgcagccgctcgggccgataaaacagataaattcaccttttgcaatatctaaatcaatgctgttcacagcttttttgccgcctttatatacttttgacacttgttccaatttcagcaatccgtgcacctccgcaggtttcctttaaattttctgaaaagtataatccttattatagtttgaactttgtaaaataaaaagtttacaatgtgttgaaattatatgttatttatagattatttattgttatgaccgagacggaaagggtgttcttacaattacgccggatacctcccacttcctctgcattcagctattttcaacaccaggaagaaatatgatatattgacaccatcaattgccatttgaagggatgatcagctgtgaaaaaaaccgctctcgacatcattgaacatgctgaagagcatctcattgagaagattgccgaaaatatgcatacgtttggaatgccttcaactgtcggacgtgtgctcggaattatttatatgaatcgaaaaccaatgaccttaagcgagctctctgaggcaacgggcatgagcaaaacacggatgagccaggttgtccgggaaatgatcgatgccaatatcgccgaaaaggtgtttgaaaaaggcgtacgaaaagacctttatgacgtcgagcaggattattatcaaaccttcatttctttatttgcggcgaattggacaaaggtcgtgagcaaaaacaaagtgctgtataaaaaattaaaccgggagctgagtgatcttttacaaagggacgggcttaccccggaagcggaagagaaagtcaatcagctgctgaatgaattaaaagaatggcttcattactatgattggctgagcaggttgattgaattttttgagagtgaggaagtctttcggtacgtgccaaaaacaaaagaaagcagctctctaaaataagggagctgctttttgcatcatgaggttaagatcggaaacatgcctttcagccccgcaccaatcatcccgaccgcaaccacggctaagattaatcccatcagtctggtaatcacattcatctcggtttttccgagtttgctgctgataaaagcagaatagtggaaaaagagaaaggtcagggcaataacggcggctatgccgatcgtgacagccgcataatgaccaatgccgctatgaccggcggaaaggctcatcactgttgcaatcgttccgggcccagcaatgatcggaatggataaaggtgtgactgatatatccgctttttccttgctttccttatgttcatcatggtgaagagattgcacgtgtgattctttcgcattcaatagattataggcaatgccgaaaatgaatatgccgcccgccactcggagcgcgtaaatgttgatatcaaacagtttaaagataagatgaccgaaaaccaaaaaagctgcgagaataaaaaaggataaaatagctgccttccgggcaatcgcttttctttccgctgcagtatagccttctgtcagcgtcagaaatatcggtacgtttccgatcggattcgatactgcgaataaaaaatgaagacgtgaacgataaatgagaacatcatatacctccttgttgatagtctctgcacaggaaatagaattattctccacccttttacccggaggcgatttcccggtaaacctttatagcctgtcagaaacgcgccatgctacaatgaagtgacaaattgaataggaaggacgtatacagatgttcaaaaaaattgcggcagatgccttgggcttatctgatatcggaaaaattatcgtacctcaggactatgacaaaacagacgcagacgactatgtcatgcatgaagataatgagaaaatttatttcttgattaaaacaaaagcagacgagtattgctttacgaacctggccctgatccatgtagacggcgaacgcgccacttcctcgaaacgaacgttgaaacgctatccttattcgcaatataaaatctctgacgtttttcttgaaactgccggaaaagtggatttggatgttgaaattaagttcaagctgggcggtgaacaattcgacattgatgtccacaaagaccagattgaaaagttaaaagacctttataaagcactgcttcgcatcgctgaaacaacctatgaaaatgacattttaatcaatcaagcggagcaaagcttagataaagcagtgacgattcttcaccatacccgccctgagcacgtcaatattgaaacgcaatacaaagagctgaccgaattcggattcacttggctgacatccgttcgctcgcagtatcatattaaggattttggggatgtatttgagaaatatattaataactagataaaagaagacacagctgctatcgtgctcgtgtctttttttgtatgaatattgattactttacaacttttttcttttataataaaactattagtctattttccctatattacagataaaggagttattttatgtattgtcctcaatgcggccatcaaacagatggcggaaatttttgtgagaaatgcggatcaccgctccccggtcaatcaggccaccagcatgcagctcaaactggagccgctgcaaagcaagcagcaaaacagttcggttcatttgtcttatccgtcctgaaacgcccttatcaggaatgtaaagcaacaggcggagaacagctgatcagcgcaatcattacgatcgttcttttcagtttgctgacccctttgatgttttatattcttttttcagacggtcccgaaagcgtaagctttacagcaatcttcttagagccaaccatttattttattttatttctatttggcctgcatgcatgcatctttttcgccctgaaaatcgcgggaaaccaagtatctttcaaggattcattctcaagattcggagcgtttctcataccgtttacggctattttgattcttgcccttttcttctttttattacatacagacatttgctttaccatattagccgttggtttaatcggtgcattcttcgccattcctcctgcgatgctgagcagttaccagcattcatataaagggaaggttgatgtcatttactcaacgattgtaatttatctgatcatctgcgttacatttcagcttattatcgaacactatgtcaaagaaattttccgttatatgctcttttaaaaacaatcccatcacctgctggtgatgggattgttttattgaatagacgttaagtaaattcttccgttcttcactacgccggtgtaggtccagttatatgttctgagctttggactgccgcctgattttgtgatatagaattcttcatacgtcttaatcgtgatagccgacccattttggctccagcttttcacttcatagttattaaagtcttctgttgtcccctctttatttaatttcgacacgagatgctgctggtcggaataaagggaactgcctttttcaaggctgtcttccatcagtgagaaattattttgattcacggcatctgcctgactttgcagataactgcccataaataatgtcacttgttcatctgtaacatcgccgcttgcagagctttcactgcctttgtttttcgagccagcccaggcggaagtgtatgtctctggtttatcatttttgattttctttatatttgtgcctgcagattcgaatgttgattctgcatcttcgaaaatccactttttctgttttttatcatatgaaagaagatattcataactcggactgtcgtcagtcatttcagattttgtatagtcgttatacgaagaagactggtgaagttcttttcctgttaccgatacctgccacgttccgtcgtttttctgagagagggcaaatgtgtccaggtcaaaatcagtttccaagtatctatcttttaagtatgaatccgcgcttttcatagaatcgacggtgtccttcgtctccgccttccaattggcacttgcctctgtcatctgggctgtattcccatcagatagagctttggagtattgttttgttgttttgacaattgtgttcataatctgttcctgtgtatcttgatcaggaattaacgttaactccatttctttatcatcgatcggaacgccggcagtttttgtttttccccacggaaattctgcctcgactgaagctgtcattgatccatctgtcagcagcggaccatatgttacggatttgaacggatctttatgaattgacttgccgttaatcagcaaatctcccttcccgctcttgatgtcatccgctaagctgaatgtcacatcgtctgcttccaatgagagatcaacacgaaagctgctatcgccaatcgcctgaatgtcttcctttttcacaaggtcaacgacatcgtttttcagtttggctgagactgtatattcgccgggaatgtacggaccaagggtttgtgcttgatctgctttctttacagatccggcttcctctttattgacatatagatcggtatttttataattgctgctcacttcaaaataaacaggtgctacctttaagtcataatggtcaaataccagcaggcttttcccgtctttttctgcatatacgatatccttctgggctgtttcatcccgcagcgatgcaaaaagttcatcttttttgtctggatgatccttcaaatatgtaagaaacggttttacattatttttagtgagtttaagattgtcatttaccggtgtaagcagagtcgcgatttggtcctgatccccatcatttacggcctgttcaaacttgtctactaacctatcctttgaagtaaaatacgctccggttttatatgcggcgaataatataacgcacgccgcggcaatgctgctccataaaatgatggttttcttagggatcggttttcgcggagcctgccttgtttctgcagtgctagctgtttcttgatttgcctgtttgctaccccctccgatcggggtgccgcattgtttacaaaacttggctccttcattattctgggagccgcaattcttacaaaaaaacatgactttcctcctattctactaatttgataacatttactgcttttcatattttataataaaacagaatgaaattgggaacgaatgaaaaaattaaatgtctatcagactaaaaaggtggtacgaatatgcaaaagctcaggattgaattaggagaagaaacaaatgacgaactatatgatctattgctgctcgccgatccatcgaaagacattgtagatgaatatcttgagaggggagaatgttacacagcttgggccggtgatgagcttgcaggggtttatgtattgctaaaaacaaggccgcaaacagttgaaattgtaaatattgcggtaaaagaatctcttcagaagaaaggctttggcaaacagcttgtacttgacgccatcgaaaaagcgaagaagctgggggcggacacgattgaaatcggaacggggaattcgagcattcatcagctttccctctatcaaaaatgcggattccgcattcaggcgatcgaccacgatttctttctcagacattatgatgaggacatttttgaaaacgggattcaatgccgcgatatggtaaggctttatttggatctctgaaagcataaaaaagccgccgagagaaaatcccggcggtctttttattacttgtttaagttgtagaaagagttgataccgtggtattgagcagtttcagccaactgatcttcgatgcgaagaagctggttgtatttcgcaacacggtccgtacgagacggagcacctgttttgatttgtcctgcgtttgttgccacagcgatgtcagcgattgtgctgtcttcagtttcaccagaacggtgagagataacagctgtgtagcctgcgcgtttcgccatttcgatcgcatcgaatgtttcagtcaatgtaccgatttggtttactttgatcaggatagagttgcctacgccgtttttaataccttcagaaagttttttcgtgtttgtaacgaagaggtcgtcaccaacaagctgaacttttttgccaagacgctcagtaagaagcttgtggccttcccagtcgttttcgtcaagtccgtcttcgatcgagatgattgggtatttagaaacaagctcttcataccagtcaaccatttcagcagatgttttcacaacgccttcgccagacagatggtatttgccgtcttctttgttgtagaactcagaagatgcagcatccatagcaagtttaacttcttcgccaggtttgaagccggctttttcgattgcttcaacgattgtttgaagcgcttcttcgttagaaccaaggtttggagcgaatccgccttcgtcacctacagcagtgtttaagccttttgcgcttaatactgatttcaggctgtggaagatttgagcgcccatgcgaagtgcttcacggaagttaggagcacctacaggcatgatcatgaattcttgaatatccacgttgttatcagcatgctctccgccgtttacgatgttcatcatcggtacaggaagcgtttttgagttgaatcctccaaggtattggtaaagaggaatctgtaagaaatcagcagcagcacgcgcacaagccatagatacgccaaggattgcgttcgcaccaagtttacctttgttttcagtaccgtcaagctcgattaaaagctgatcgattgcgttttgttcagttacatcaaagccaagaagctctggagcaatgatttcgtttacgttgttaacagctgttaacacgccttttccaaggtaacggtctttgtcgccgtcacgaagctcaaccgcttcgtattcacctgtagaagctccgcttggcactaatgcgcggccgaaagctcctgtttctgtatatacttcaacttcaactgttgggttgccgcgggagtctaatacttcgcgtgcataaacatcaacaatgtatggcatgagttttgtctctccttttgattttcaaattatttttgaattaaagatgttcctgtcatttctttcggtttttcaacaccaagaaggtctaataacgttggtgcaaggtcgcctaggattccgccttcacgcagcgtaatgccttctttcgttacaatcacagggactgggtttgttgtatgcgcagtgtgcggttcgcctgattctgtaatcagaatgtcagcattaccgtgatcagcggtaatgatagcgtgtccgcctttagcaaggatcgcgtcaacgacttcgcccaagcattcgtccactgcttcaattgctttaattgttggttcaaccattccggagtggccgaccatatcagggtttgcgaagttaagaatgatcgcgtcatgcttgtcagcttcaatttctttgacaagcgcgtctttcacttcatacgcactcatctcaggcttcaagtcatacgttgcaactttaggcgagttgatgagaatacgctcttcacccgggaattcagcttcacggccgccgctcataaagaacgtgacgtgcggatacttttcagtttctgcaattcgaagctgttttaacccgtgctgagataatacttctccgactgtgttatcaagatttatcggtttaaacgctacatagccgtcaactgtttcactgaagtgagtcaggcagacgaaatacaggttctttggataattctcgccgcggtcgaagtcacggaagtctttgtttgtgaacgtgttggaaatctggatggcgcggtccggtctgaaattatagaaaatcacagaatcgccgtcttggattttcgcaacaggctcaccgttttcttttgtgatgacagatggaatcacgaattcatcgtagataccatttgcatatgaatcatcaacaacatccagggcgctgcggtaagatgggccttcgccgtacgccattgcgcggtacgctttttctacacggtcccagcgtttgtcgcggtccatagagtagtaacgtccggaaatgctggcgatttcacctacaccgatttccttgatttgatcgttcaactggttgatgtacgttttcgctgtctgcggacctacatcacggccgtcaaggaagccatggatataaacctctgtcagcccttcttttttcgcaagctttaacagtgcgaataaatgattgatatggctgtgcacgcctccgtcagataaaagaccgaacaggtgcaaggctttgttgttttctttcgcgttgctgatcgcgtcaaggaatgtttgattgcgttcgaactctccttcgcgaatggcaacatttacgcgtgttaagctttggtacacaatacgtcccgcaccgatatttaagtgacctacttcggagttccccatttgcccttcaggaagacctacagcctcgcctgaagcagtcaatgtttgatgaggatactggttccaatagcggtcaaaattcggttttttcgctaaagcgactgcgttccctactgtttcgttacgtaatccgaacccatcaagaatgatgagtgcagctggttttttactcatattgaccttcctccaataattgaacgaatgactgtggctcaaggctcgcgccgccgaccaaagcaccgtcaatatcggactctgccatatattctttaatgtttgcaggctttacgcttccgccatattggatgcgaagcttgtctgcagcttcttggctgaagctttcagcgacggttttacggatatgcgcacacacgtcattcgcatctttcgctgtagaagatttgcctgttccgattgcccagattggctcatacgcaataacagaagcagcaacttgttcttcagaaagaccagcaaggccttttttcacttggtcagcaacaagatcatttgttttgccggcttcacgctcttcaagcgtttcacctacacagatgatcggcacaatgccgtgtttgaaagctgcgtgtgcttttttgttaactgtttcatcagtttcagcgaacatttcacggcgctcagagtggccgatgacgcagtagtcaacgccaaggtctttcagagcaaccgggctgatttcgcctgtgaacgcgccgctttcttcgaagtgcatgttttgagcgccgacttttaggtcagtgcctttcacagcagaagcaagcttttctaagaaaagcgctggcgcgcaaacaacagcttcagctttgtctgctgctggaatggaagatttcacttcttcaacgaagctgacagcttcgccgagtgttttgttcattttccagttaccggcgataattggttttctcatctgttccacttccttatagcagttttgagattatttatcgttcagtgcagctacccctggaagctctttgccttccataaactcaagggatgcgccgccgcctgttgagatgtggctcattttgtcagcaaggccgaatttttcaaccgctgccgcagagtctcctccgccgatgacagagtatgtatctttcgcctctgccaatgcttccgcaaccgcttttgttccttgagcgaacaagtcgatttcgaatacgcccattggtccgttccacacgacaagtttgctgtttttgatgacgtcagcatacgtttcgcgtgttttcgtaccaatgtcgattgcttctaaatcactagggatttcagagatcggcacaattttcacgtttgcatcgttagagaaatcatctgcaacgagtacatcttcaggcatgtagaagttaacgcctttttctttagcgcggtccataaatgatttcgcaagctcgattttatcctcttcaagaagagatttaccgacttcatagccaagcgcttttacgaaagtataagcaagacctccgccgatgatcaggttgtctactttatcaagaagactctcgattacaccgattttgtcttttactttcgctccgccgatgatcgctgtgaacgggcggtcaggattggaaaccgcttttccaagtacatcaagctctttttccattaagaaacctgcaactgctggcagatgctcggcaattccagctgtagatgcgtgagcacggtgggcagcaccgaatgcgtcatttacatatacatctgcaagctcagcaaatgcttttgcaagctcagggtcatttttctcttcaccaggatagaaacgtacgttttccaatacaagaacgtctccgtccttcatctcagaaatttgtgcttttacagcatcgccgtatgcttcatccgcttttttcacttctttgccaagcagttcgccgagacgtgcagcgacaggagttaaacgaagctcctcaaccacttcgcctttcgggcggcctaagtggctcgcaagaaggactttggcgccttggtctgcaaggtgtttgattgttggaagcgcagcacggatacgtgtatcgtctgttacttccccgtctttcattggaacgttaaagtcaacgcggcagaatacaactttgccttttacgtcgatgtctttgagagtttttttattcatgcctaggagatcctccttcaaaatggtttgcatacagcacgaaaaacgtgaaaccgtctgttcaagcgataacgccgctagggcagatcgcagtctttttcggcacagggcagttcgtctaaaagccagggcagcggccttaggcgaaagcgccggcaaagctgcttaaaacgcggtcgtttctctatcacagagcgttttctgaaagccggtcttcatggaaaaagggaaagggagtccgtccccttcccttgtccgctttcattatagcgcttctattcgaaagaaccaagtcaggtcctttttcagctataaattaaagacctttttttgcgatgtaagctgcaaggtcaacaacgcggttagagtagccgctttcgttatcgtaccaagagattacttttaccatgctgccttccataaccattgtagaaagagcatcgattgtagaagagtttttgtttccgttgtagtcgccagaaactaatggctcttcgctgtagccaaggattcctttaaggtcgccttcagccgcttctttaagagctgcgtttacttcttcagctgttacttcttggttcagttcagcaaccaagtcaactagagaaacgtttggagttggaacacgcattgctccaccgttcagtttgccttttagttcaggaagaactagagaaactgctttagcagcaccagttgatgttgggatgatgttttcagctgctgcacgcgcacgacggtagtctttgtgcggaagatcaaggatttgctgatcgtttgtgtaagagtgaacagttgtcatcataccgcgtttgatgccgaatttatcgttaagtacttttgcaaacggcgcaaggcagtttgttgtgcaagatgcgttagagataacatcgtggttagccgcatcgtatttatcttcgttaacacccataacgattgtgatatcttcttcgttagcaggagcagagatgattacttttttcgcgccagcttctaagtgtttcgcagcgtctgcgcgttttgtgaagaaaccagtagattcaactacgatttcaacgccttgtttgccccagctaagtttagcaggatcgcgttctgcagaaacttcaattgttttgccgttaacaacaaggttgttaccgtcaactgaaacttcagcgtctaattttccgtgtacagaatcatattgtaaaaggtgagccagcatgttagcatctgttaaatcgttaaccgctactacctcaacttcaggattgtttaatgctgcgcggaatacgttacgtccaatacgaccaaaaccgttaataccgacttttactgccatgattgtttcctcctttaaataagtgagagatatttatattgagggattattcatcccttaataacttctttgcggctccttcgtctgtgacgagaaccgtgttgcgtggctttttaaagtaagcctcgatcgcctcggcttttgatgatccgcccgctaccgcaataatatcggggatggcgtctatgtcatccagctgcattccgacagaatgcactttgtgaaccacttcgccgtccgcgttaaaatagtagccgaacgcttccgtcaccgcgtcgttatcatctattttctttaagtcttctaaaggcgtgtttctgcgctgagccatagttttagcttcgccgattccatgaaccagcatactcgctgatttaatggtgttcagcacctctttgacagaaggctcttcaataatagatgaataggcgccttgtgacagctgtcccggaacaaacaaaagccggtaagtgcctgaagccttctccgccatatgcgcgcatatggtgttcgcctggtttttcacgtcttcgcctaaaccgcctcttgcaggcacaaacaaaagctcgcggtttttagaatccggcgtcatcatttcggcgacagcttcaattgtcgtaccgccagttacagcgacgatatttttgcctgaaaatctttttttcatacatgcgacagccgctcttcccatttcttttttgacccatggggattgatcgctgtctccggatacgataatggcatcctttagatttaaacgttcttttaatgtcttttccaaaagagtcaaacctaaaacatctttcatcgtatcttccaaaacagaaagcagttcatagccctcttctgtcaatgtcatgccgtttgtcttaatatcgaccaggttctgttcctttaaaaactgaacctcgcccctcagcacacgctcgctgatttcgagactggcagacaggcttcttcgcccgatgggttctgtcagcctgatatactgcaagatttcaaacctcttttgcataacgagcagaagatcaggcaataattttttttgagcttgtattaactggttcatgactcaaacgttccttccttttttgctggacgttatatgtcccgctatgacaaaaaacgtcccgtcatagccaaaaaaaatcatttctgctttctttaattattttaacagggtggaattgtttattcaactgttaagagccaattcatcgacaatattcgcagagttttcatgccgcgtcgttttatccagcaatattttatcctatatatctttatcttatacagaaagcgccaaatggtgcatcccaatataaacagcccttcccgtagaaagggctgtttcattaaagcgttttcattttatccaaagcttttcaatttcctcgagcgatttgttcttcgtttccggacagatcgtaacgacaaacaggaaacaaaggatgttaatcaccgcaaagatccaaaatgtataggcgagcccgaaagaatcgatcatcattggcacaaactgtccaatcgcccagtttgctccccataaaaagatggtcgcaatgcccgcggcccgcgcacgcagatggttcggaaagatttcagaaatcataatccatgtgatcggtccgaccgagacacagaaagcagcgacaaaacctaatataaggacgatcatcatgatcccgcttgttaactcaaagtaaaacgacgtcccgattaaaatcataaaaatagccataaaagcagaaccgatggacatcagtttttttcgtccgactttatcaatcagcaacaccgcaataacggtaaagatgacttctacaacaccgacgatacaagttgtcacaaatccggcgttttgcccgaatcccatcattttaaagatttccggcccgtagtaagtaatcgcgttcatgccgatgacttggttaaagagcgccagcaggattccaatgacaagcgcctttctgagccccggcttaaacagctgggagagcgaccccatttgttctatttttaaagagttctcaatgttctttaattcttcttttgcaacagtttctccattaatacgtgtcaggatctttaaagcttcatttgttttgcccgctttcgccagccatctcggactttccgggacgacgagcaggacaaggaaaaagatgacggacggcaccattccataagcaagcatccatctccagccggtgtgcacgccccattcgtatgttccggaccgctgcacagctagattaataaagtatgtagcggaaatacccagtatcgtaaagagctgatataaggaagataaacttccgcgtatggcgggcggtgccgcttctgtaatatacgtaacagagagcgatgagcccatcccgattcccagccccccgataatccttgcaatgattaaggtggacacgtcttgagaaagcgctgaaacgattgctgatatcgcaaataacaaagcggctgtcattaaaatttttctccggccgaatctgtcacttaaaaagccggatatcccgacgcccacaactcctccaatcataatgcttgaaatgacaagtccctccataaacggactcaggctgtataaatctttcagaaaaccgatggcgccagaaatcactgccgtgtcatagccatacaataagccgccaagccccgccgcacatgagatcaaaatgacaaatcccattgaatggcttcgtgttacaggaacatttggttctaattgagttggagtattcttcatttccctgccctcccgaatgttgagtaaagcgttttcatttaaaccttaaattgtacgtacttatattaaaatttaacgaaaattacatttaattagtacgtacaaatatagaataatcttgtttgcattttctgtcaatgttttcttacaaagaacgctgtgatatactgaaatttgtccgtatacattttggaggaatggatatgttaccaaaatacgcgcaagtaaaagaagaaatcagttcttggattaatcaaggcaaaatactgcccgatcaaaaaatccctaccgaaaacgaattaatgcagcaattcggcgtcagccggcataccatccgcaaagcgatcggagacctcgtatcactaggtctgctgtacagcgtgcaaggcggaggcacctttgtcgcttcacgctctgctaagtcagcgctgcattccaataaaacgatcggtgttttgacaacttacatatcagactatattttcccgagcatcatcagaggaatcgagtcctatttaagcgagcaggggtattctatgcttttgacaagcacaaacaacaacccggacaatgaaagaagaggcttagaaaacctgctgtcccagcatattgacggactcatcgtagaaccgacaaaaagcgcccttcaaaccccaaacatcggctattatctgaacttggagaaaaacggcattccttttgcgatgattaacgcgtcatatgccgagcttgccgcgccaagttttaccttggatgatgtgaaaggcgggatgatggcggcggagcatttgctttctctcggccacacgcatatgatgggtatttttaaagctgatgacacacaaggcgtgaaacggatgaacggatttatacaggcgcaccgggagcgtgagttgtttccttctccggatatgatcgtgacatttacaacggaagaaaaagaatcaaaacttctggagaaagtaaaagccacactggagaaaaacagcaagcacatgccgacagccattctttgttataacgatgaaattgcgctgaaggtgattgatatgctgagggagatggatcttaaagtgccggaggatatgtctattgtcgggtacgatgattcacatttcgcccaaatctcagaagtgaaactaacctctgtcaaacatccgaaatcagtgcttggaaaagcagccgccaaatatgtcattgactgcttagagcataaaaagccgaagcaagaggatgtcatatttgagcctgagttgatcattcgccagtccgcacgaaaactgaatgaataaaaaaagcaatgtatgggtctccccgctacattgcttttttttatagctgttatctgttgttccaaacgtcagcgatgatttcaaacgaacgcattctgtctgcgtgttcaaaggtttctgagttaaccataatttcgtcagcctgtgtcgttttgacgaaatcttcaagcttcgccttcacttcttccggacctccgacaatcgtggagctcagctgctcattgaccatcgctttttcatacgggctccagatttgatccatatcctcaacaggcggtttaagctggttcggcgtaccgcggacaagatcaagaaacctttgataatgcgaagtcgcaaggtgctgcgctttctcgtttgtatctgccgcgataatggtgacaccgaccatcgcatacggttcgtcgagcacgtctgacggcgtgaaggaattgcggtaaagctccaatgcaggaaccgtattcgctggtgaaaaatgagcggcaaaggcaaacggaagacctagttcacctgccagacgggcgctgaagccgcttgagcccagcagccaaatcggcacatctatgccctctccgggaatggcgcgaacttgattgcgcacatttcctgacggtttaaaataattgcgcagttcctctaattgttctggaaaatcctccccgctgttgatgtttctgcggagcgctctggctgtcaattggtctgttcccggcgcacgtccaagccccagatcaatccgcccgggatacagtgtttccagtgtgccgaattgttcagcaatgactaatgaagagtggttcgggagcataatgccgccggaaccgacgcggattttcttcgtgcctccggcaatatggccaatcaaaactgcagtggcggagcttgcaacaccttctatattatgatgttcagcaagccagtaacggtgatagccccattcctctgcccggcgcgccaagtccatgctgtttcggaatgattctgcaatcgttcctccctgaacaaccggagataaattcaagacagaaagcaaggtatctttgcgttggttgttagacatattgttctcctttgcaaatgtgttatcagtaaacagcccaaagctgtcaggtcatgattgaaagaacttctatcacaccataacacaactgcattcaggaataaaagaattttattcgatgaaattcgaacaatgtaaaacgaacggtttggcccgctattctgctccaaacagctccttagccatctcaataaagagcttagccgccagagaagcctcctttagcgacggaacagcaagctgcacatcacggtatacctgcgggtccaattcccgggtcaccacatgctccggaagcggcatccccgacatggacatttctgataaaatcgcgagacccaggccttctctgatcatactgatcgaggtgttgatgttatagaccgtgaaagctgggtgcagcgtagcgcccgcctgcctgaacatatcgacaaatggtgattcatagcctccgtcacagacgatcatcggttcatggtcaagatctttcagcgtaatggccgaatgactggcaagcgggtgatcgtccctgagcacgacagccattttgtcttttttcaaatgaatgtactccatctcctctgttggatacagaagaatcccaacatctatcatccgcgtatgaagccactccttgacttcatttacagttccctcgtgcagcacgagctcaagttttggatatttttgtttaaattcactgatcagcttcggcataaaataagccgaggcagttgagaatgtgccgatatggatcgttcccagttcaagccctttttccgctgctgctacctgctcaactttttcaatgccttttaagacttctctaatgtatactaagatctgttttcccgtatccgtcagcatcaggccattgcggcggtcacgaatgatcagctttacatcaagctcagcttcgatcgcagaaatcgcatggctgacagccggctgtgtcatgttcagcgcctgacccgcttttgtaaagcttcccgtttcagctattttcacaaaaacctttaattgtgtaatggtcataacaatttacttatgctccttataaaaaagattcattttatttatcttatgttctaccgtatcatatgatggaaaagttctacaaggagtgaatgaacaatgaagcagctctcaaaaacgcggacagctctcctgctcgcatttctcgtcatcatgtggggcgtcaattggccgctgtccaaagccgcgctcgcctattctccgccattattgttcgcgggcatccgaacgctgatcggcgggcttttattagtcattgtcgcactgccgcgtattcataaattacgcttaaaagaaacgtggccgatttatcttgtttctgctcttttaaatattacgttattctacggcctgcaaacgatcgggctgaattatcttccggccggcctgttttctgcaatcgtcttcttccagcctgttctgatgggtgtattttcttggctgtggctcggcgaatccatgtttgtaatgaaagtgattggcctcatcctcggttttgcgggagtagccgtcattagtgctgcgggctttggcgggcatatttctgtcattggggttctgctggctctcggctccgcaatcagctgggcgctcggaacggtatatatgaaaaaaacaggcagccgcgtcgattccatctggatggtcgctctgcagctgacgatcggaagcgtgtttctgctaatatccggcttttggacagaaagcttttcggcgatccaatggacagctccgttcattacgagcctgctgtttatctccgtattcgttatcgcactcggctggcttgtcttttttacgcttgtcggttcaggagaagcaagcaaggtcgcatcttatacttttttgattccgctcatatcaatcgtggccagctccattttcctgcatgaaccgctcacccttagcctcttggcagggctgctgctgattgtcacgagcatctgtctcgtgaatacaaaatcaaaagcgcagaaagctgcggcgattggtataaacgagaaagctgcacaataataaaaaccctcttgccggatgcggcaagagggtttcttatttactgatgcttgcgtcctttgaccaaatatgcaactgtaatcaaaaggtagatcgccgcagtaatgccggtaatgacaattgatgttgtcatgatgaccccgatcagaatggcgagtaatgccacaatcgcaaaccatgtcgtgtacgggaaccattttacataataggccggtgtttccgtttgctgttttctcgattttaaatgagcgaatccgatgatcagccaaatgaataaaacggtatatcccaatgatcccattaaataattaaatgtttggcttcctgcgaacagagaaatcaatacgccaatatagagagaagaagtgcacatcagaatcgcaaacatcggtacgtttttcgatgaaagcttcgagaagacctttggaagccttccgtcacttgcctgtgtatacaaaatgcgtgatgatccgtataaacctgaattcatagaagaaatgatcgccagcaggatgactgcattcatgatatgatccgcgcccggaatgcctaccattttaaagaccatcacgaaaggactttccggaaccgaattgacttggttccatggaatcaggctgacgatgatgaaaaacggcagcaggtaaaacgcgacaatccgtgtcagtgtgctgcggacagctttcgggacaaccttttccggattttttgtctctgcaagcgttacaccgataatttctgtaccgccgtaagagtagatgacgacaagcatcgccgtgatcagccctgtgccgccgtgcgggaaaaatccgccgtggtctgtcaggttggaaaatccggatgctgtatgatcaccgaatgatacaaataagagcagcaatcccagaataataaagataataataacggtaatcttgatcattgccagccaatattcggtttcggcgaagattttaacagaaagcaagtttacaatcgtgacgataagagaaattcctaatgccaacacccagatcgggcagcccggcagccaatattgaatgaaaattgcagctacaacagcttcagccgcaatgttgagcacccacattttccagtagatccagtccaaaagtaagcggcgtaatttcccaatacctgttggacaagatcacggaaggttctggcgttacggtttcgaacagccatttccgccagcccctgcataataaacagcaaaataatcccgccgagcagatatgcgagaatgacagatggccctgccacatcgatcgctgagctgctccccttaaataaacctgcgccgattgctccgcccagcgccatcatcataatatggcgggacgtcatcgtgcgttttaacgtttgattgtcgtttttcatcctcttctacctctccttctcgttttcaaaaacaaaaaagcccgccgtctcctacctaatctaatagataaagagacgacgagccttcggctgaccgcggtaccactcttgttgattcttcatgaagaatcctgcttttgacctgtaacgaaggttagccgttaaaacatagggaatattcaatctattccgttccgtcttaccactcccgggcgagttcaaagaagaatcaggctgcgtcgcaccaccccgcagctctctgttctgatcactttcttttactgctcccaatctatgtgttttagttttctgaaaaactcaaattttatgatctgaatatattaacataatatacgtgcttctcttttaactgtcaataacttcagagaaaaaagaaactgttattttgtcccttttcgaatggctttccaaaaggattctgactcgtttcctaatgcgtaaactgaaacacctgctattttatattgctttgccagatggcttttcgtttgaacggttttttcgttttcataccacacgacatgtttatgcttctttttgtcaacataagaaaacgtcatcgagcctgattttttgttgaatgccggctttgctttttgttttttgatgagggatttgagctcattccattcccttattgtgctggtacttccgtcttttacatcccagtcatagccgtacgcagggattcccatgatgactttattggctttgatctttttgactgaaaactgcagagagcttttgatccagtttgtgcttgccactgaccccggctcaccccaaatgccgtgttcatcgtaggtcatgacttgtacgaagtcggcatatttgccgattttcgcataatcatacggccagctccagtcatcatttttatcatcggcgcttttggccggaacggataccattgttttaatatgtttcttattcaaagcctgtgagacatattgaatgaagttcgagtatgcagcgcggtcttctggatttactgcttcaaaatcgatattgattccgtaatatgagtgctttttggccagtgtaattaattgatctgtgaatcgttttttcgctgttttattgctcatgacccgactcgctaaatctccgtcaaaatcataaatggcatcattatagtttgaaatgacagcccatgtcttgatttttttctttttcgcatatgtcagctgcttagttggggcatcgccaatgatttgtccgtttttttcaaacgcaaatgtatcggttgcgatggcattcatgtatgtatgatatttcgtaagagaattgtatgaagccgtatccccagtcgtgtagcctactgtcataccggctgccttcgcttctccttttgtatacataaacagaacaatcgcaatcgccagtgaaaccgctatgatcagccattttttcattgcatttcctcctgtatcaagtcatactcttctcatcggccaaaaaattggaagttgaagttttttcaagcaaaaagcccggcatatgcctgccgggcttcctgagttcagcggtcagagacgagaatatatgctgcctttactggtccatgcacccccacaactaaatccatttcaatgtcggctgagttactcggtccggtaatgtagttgatacatgaaggaacagtgacaccgttcgcaatgttttggcggatgatatcactggcttgtgtcattctcggtacaatgcttgatttcggcacgatcgcaatataagtcgttggcaaaaggctgacagagcggccgatgtcttttgaggagaagaggacaaccgtccccgactcagccaatgtaatttcgctgaatgtaatccctacattggcttgctccgcttttttaatattttcctcgcctttgtcagcatcccactcccagaccggcgttccttcactcggccagtccttggtgagcaggcttttcagtccgtattcttcaaagcgggggtccttcggaatgatgacagggcctccagaaaagcggctgacttgctcgcgcagggcatcgtaaaggccggttgaatccgtttcaatcagctctgtatggattttgacgcaatggtttttgagcactgtgactaagtcatccgctgaataaccttcaagtgttttatattgcggctcatacgcccattcagggactgccacgcctcctgttcttctttcacggcccaggctggatgcgattcgatttaaaaagctctcttgattctgaatggttcccttcgtcatcactgctcctccttcgtgcgttcacttgtttctctgtccgcaaaccagtctctgaatctcgatttatgcggtgccgggaagtcacggatctgggtccaatttttaagcgggccgggccctttcgaaattttttcgtcctctgtaaaaggcgtcatggcggccggcgcccattttgagcccattttgtaaagcgataaagaggatgcgccaagtccgaatgctttcattgcaagcttttcactgatcggcgctctgccttctttttcgacgatattctgacgatgcttgagtagcagctcatgaagcgggattttgaccgggcaggcttctgaacaagcagcgcacagtgaagacgcgtacggcagctccttataatcgtcataaccgccgagcaacggcgataaaaccgctccgatcggtcccgagtagattgagccgtatgaatgtccgccgacatggcggtacacaggacagacattgatacaggcggcacagcggatacattgcagcacagactggaattccgttccaaggatattggatcgtccattgtcaacgatgacaagatggaattcttccggaccgtccacttcaccttccagcttcggacccgtcaaagctgtaatataacttgtcagccgctgtccgacagcacttcttgtcagcatgctgacaagcacttcaaattcagaaaatgacgggacaatccgctccattcccatgacggtaatttgtgttgtcggcaaggtgctcacaagccgtccatttccttcattggtcacaaggctgacagaacccgtgtcagcgatggcgaagttacagccggtaatgccgatatccgcttccagaaactttttccggagaatggcgcgcgcatgcatcaccagctcttccggtttttctgtatgttgatagtccagcctttctttaaacacatcgcgtatctgctctttatttttatgaagggcgggcgctacgatatgtgacggcggatcgtgatcatcgatctgcaaaatatactcgccgagatcggtttctacgacttcacagccttccttctccagcacctcattcagattgatttcctctgtgaccattgatttagatttcacaattttcttcccgttcttcttttgaatgacatcacgaatataagaagacgcctcttccgctgtttccgcgaaatagacatgtccgcctcttttcgccacattttcggcaagctgtccgagatagaaatcaaggttttcaaggacatgctgcctgatttcctctgataatgagcgccactcctcccagtttcccagttcttctgctgcctctaggcgccgcgtccgcagacgctcctgtgcacctgaaacagcgcctctcataaattcattatcaatcccctgtgatacccgctctttaaaagcgtcagtaccgattttcatcgccatgatcctttccccctctgaatccagttttatctgctgttgagcacttcggcgatgtgcatcactttgacattcttatcttttcggccaagccgtcccccgatattcatcaaacagccgcagtcagcaccgatcagcacctctgctcccgtttcctccacacattcgactttttcatcgaccatctgctcagaaatctgcgccatcttgacggagaacgttcctccgaatccgcagcagttatgtttgcccggaagctctgtaaactgcaggcccttcacatggctcaacagcttcatcggctcctcccgaacacccagcagcctagtcatatggcacgacgtatgtaaggtcgcttttgtatgaagggtcgcgccgacatcctctactccaaggacgttcacaataaaatctgtcagttcatacgttttatccgccagctttttcgctttatcggcccatttcggatcatcctgaaacaggtgcggatactcccggaacatcgttgtacaggaaccggaaggactgacaacatattcggaatcctgaaacgtttcgatcatccgtttcattgcttttttggcgtcatgtacatagccgctgttgtatgccggctgcccgcagcaaatctgcccttccggaaaatcaacctcgcacccaagccgctccagcagctcaaccgttgcttttccgacatttgtttgaaacatatcaacaagacaagtgacaaaaagtgagactttcatgatgaacccctctctcatccccaatatatgatcaggtcatctgatgacctgagttaaaataactatatgaatatcgtacactattctgacaatggaaggaaagagttttctagggatattttcatttgtggcatatcaaaaacactcccgatctcccaggagtgcagtatatggttaaatccagcccttttcctcagcgatgctggcggcttctgtccgatttttcgcattaagcttttggatgatttctgagatatagtttcgaactgtgccttgagataaatagagctcaagcgtaatgtcttttgttgtcttgcctaaagccgcaagcctcagaatttcttgctctctaacggttagcggattttcgtctcgcatcatattaaacgtcagctcagggctgaagacacgttttccctttacacattttcgaatggcatcggccagatcgtcaatttcgccgtctttcagcagatacccatgtgcaccggcctttacggcgcgttcaaaatatccggggcgggcaaaggtggttaaaataatgaccttgctgacgcagccttttttcattaattcctctgccacatccagcccgcttcgaaccggcatttcaatgtccataatgcatacatccggctccagcttcaaaatagcatgtagcgcctcttccccgttcaatgcttgtccgatgactgtcatatcctcttctaaatcaagcaaggatcccaaagcgcctaaaagcatgcgctggtcctcagcaataaacagacgaatcattcttttcgtcctccaatcattctgcttttttaataagcggaatcgtcagtgccacaaccgttccgttatgatctgaaaccgttaatcccccttcaatgagcatgagccgttcttccattccccacaggccattcccaaacattttctccttcggcgctccctttccgtcatcccgtattacgatcctcattttgtcagcaaattgagaaatggtgatggcacagtgggttgctttgctgtgcttgataatgttagtcacggcttcccgcatacacatactgataatattttgagtgacgggagatatcactgaaaagtcgtcggctccttcgtattgaaaggtaatgttccccgctcttaatatgtgctgaatgtttacgagctcctctgttatcgtgaccgttctcatatcagaaaccagctctcgaacttgcttgagtgcggagcgtgaactggtttccatttcttttgcctcaagcttggtccgttctggatcagatgcagacagccgctgaatgagctggctttttaatgtaagcagcgacagggtgtggccaagagtatcgtgaagatcacgggcgattcgaacacgttcctcccttttagagagttcttttatctgttcgttggcttgtgcaagcttagcttcaagctcaatcctccgaaacatagaacgaattccgaatggagaaatgagcataatgacgagaaacgggagaacagaaaaaagctcccgaagcgagaccgaattcgcgataaattggtataggcatggaaaaagcagtataaagattaaagcgcagaacgcacggttaaaattcgttttctctttgtaataaccaacaaagtttgccggaaaaaaacctaagtatatataggtgatattgtaaaacacactatacatcaaaataaccgccatttgcacgataagccaatatgtaaacgaagctttgcccacgctgcagaataactggcgatatgccgctacaaaaaggagcagcataccatatccgatcccctgtttgacccctgattcttttaataaagagaggaacggcataatcgtatacaccagaaagatataagggaaaaacccgaattccttcgggaaaatagatattgcctttttcatgtattacaccgcttcttgttttcttcttatatatttagatagtagcatgaagagcatcatataagcgattaatatcagaatatttttccaagtcggactcccaccccggacaagttcccacgctccgctcccgaaatgataagacggaagccactggccaatgctctgcatcatgtcaggcatgacctcaaacggcatccacatccctccgcctaaagccagcagcatataaagcacattactgattccggccgctgtttctacttttctcatgaggccgattagtgtgcctaatgctaaaaaaggcaatgcgccaaacaaaatccacagtccgctcatcatccattcaaacggtgacaaggcaatatcattgatgattgcgccgaacagaaatatgacggtaattgataaaacgtgaatgacactttggccgatcatctgagctgataaatagatatgatccggaagaggcgtaaggcggataaaggcggtccagccttgtgaccgctcttgtaccattcggatgccaagcgtcatgatagaggaacccatcacgctgaagactgtcatcgacatcaggtaatgggcttcccatgcacgttgatcagggacgttggtattcactacatttgtaaagaaataataaaaggcaatcggcatgatcagagaccaaagcacaaagtacttgttcctaagcacccttttcatttcagcgatgctttgcttttgcagcacgttcactcacatcgcctccctgttgccgtcagccagctggcgaaatgcctcatcgagcgttgcttgctcaattcgaatatcccgtgcatgtatgttttcttgaaagatcagcgccaacactttgtctgtatttgatgtctggatgatggttctctcatgctcgtggatcactctctcgacttccgggtgacaagacagcctttccaatgattcacttgaatgaagcgtaaaggaaacagactgtttttgaattcttgagcggatttgcattggtgagccgtctgcaacaagctgtccttcagtaaaaaataggattcgctgtgcggcatcatctgcttcctgtaaataatgagttgaaaaaataatcgtttttccttggtccgacagtccgtgaatggtctgccagaatcggtgtcttgatgaagtgtccatgccgactgtcggttcatcaagtataagcagctccgggttcccggcaagagccaaagcaaagctcaaacggcgtttttgtccgccggataatttttctgctcttgttttcaaatcttctttggtgagtgctgttaacgaaacgagttctttcatggacaatggattcggataatagctccggaagagttcaaggatttcatccaccttaaggcccggcatgacacttacttcctgaagcattacacctattttttcacgaacctgttgatcatcgggaacccggttaaatagtttgatttctccctcactcggtttcagcaatcctaatatcatcgagacgacggtcgtcttccctgccccatttggcccgagaatggctgcaatttctcctttttcaatactgaagctgatgtggtttacagcggtttttcgctggaaatgttttgtcacgttgcttactgttactgcttctttcatcacatgagcacctcctgatcgtttacattgattgtaaaatgacggagaagacgatgttagtatggggtgtcatgatgatggagtgacaaatgtcatttttttctcaccccggtgtctaggcaatcctcctcctgcatcttccaattcatccatcttttctatctcccatgtcctctttcttttaaactgctgtgacattcatagaaagatacactcttcaaaccatccgagtgttatgatagaaatattgaactttatattactttccggctgaaaggagccaatcatgaacgaagcgattttgtctagaaatcatgtgaaggtgaaaggcagcggcaaagcatctatcatgttcgcacctggttttggatgcgatcaaagtgtgtggaatgccgtggcacctgcctttgaagaagatcatcgggtgattttgtttgattacgtcggttcgggacattcagatttgcgcgcatatgacctgaatcgttaccagacacttgacggctatgcccaggatgttcttgatgtttgtgaagctttagatctgaaggaaaccgtgtttgtgggtcactccgtcggggccttgattgggatgattgcatccatccgccgcccggagcttttttccaatctggtgatggtggggccttctccttgctatttgaatgatccgcctgagtattacggaggatttgaagaggagcagctccttggcttgctggagatgatggagaaaaattatatcggctgggcaactgtatttgcggcaaccgttctgaatcagccagatcggcctgaaattaaggaagagcttgaaagccgtttttgttctactgatcctgtcattgcccgccaattcgcgaaagcggcgtttttttctgatcaccgagaggatctttcgaaggtaacggttccctctcttattctccaatgtgcagatgatatcatcgcacctgcaacagtaggtaagtatatgcatcagcatctgccttatagcagtctgaaacaaatggaggctcgcggacattgccctcatatgagccatccagatgagacgatacagctgatcggcgattatttaaaagcacacgtgtgatataggaacgaaagggatagaggtgaccctcttagatggacaaacaattgaatgatgcaccatgcggtttcctcgctttgtcagaagaggggtcgatcatagctgccaaccgcacccttatcaagattctggattatgagccggagcaggttatcggccagcatatgaatatgatgttgacaattcccgcacagcttttctgccagctttatttttttccgcttttgaaattggagcatcacatcgaagaaatatacatttccctgaaagctagagatggagaagaaattcccgtccttatcaatgctattgcgagacacgatagcggggcttctgtctttgattgtgttctgattccaatgcgaaagcgaaatgaatatgaaaatgagctgctgatagccagaaatgaggctcaggaagctttgcttgccaaacagaaagccaatgcggagttagagattgccttggaaacgctgaaagcaaaacaagaagaacttcttgagatcaataaacaaaatcaacaatttaaattaaacaccaaaagagagcttgaactcgccagaaagatccagaaaaactcgttgactgaaccgattgtaaacgatcaggttcagattgactcttattacaacgcatcgagtgaattgtcaggtgatctttacggatattatcaaatcgatgaacaccgttacggcattattatccttgatgtgatggggcacggaatttcatctgcattgattacgatgtctcttcatcctttgttccagcgccagatcacgcaaggtctcagccccgttaaagttatgaaggaattggaccggcaccttcacagcttgtttcaaaatgatgaggaagcaagacattattgcactgctatttatctcgagattgacatagcacggcaaagaattgattatgtcaacgcaggacatccgccggcactttggcaggacgatagcggaactcaacatctgcttcacgcgacttcgcctccgatcggaatgtttgaagacttagtatttcagtcaagcagcctttcatacacggagggcggaagattgcttctgtatacggatggcgtgatggatcctacggcttcatgttatttatatgatttactaaaggatcatcctgattcgccgatcgctgaccagaaggagaaaatccttacatcactgcagcatcaaaaggaagctcatcataagagtgatgacgaatgttttatattagttgatgtaaaataaaatgatccatgagacataacaatgatttgttacatctcatggattttttgtttcagcgtttctttggaatatgtcctgactccgcatattgaaacacctgcaaggaaggcagcgggtgtccattaaaatcaaataaagcttgattatctacagcacttcccccataccacttcccggcgtcttcagggtcgtattcagcagcatagctggacgcccaccctgacccgtatgtttcccataacactttgtttttctctatctgtgttttcggtccgaccggaatccacgcaggctcccagtagaaaacaccaagtcctgctttgcccgtattcgccactgcctccattacatctcttactgcagttgcctggccttgaacagaaattggatatggcagcgtctgcccgctttttggtgctgtatttccatgcccatcgccatcctcggcggtataggtgtacgatgtctccgccaccatgacttttttgccgtacgtgttggcaacagccttcagcacggaggtcaaattttgtaatgtgccatgccagaaaggataataggagctcgcaaacacatcataatccactttgtttttgctgagtgtttccgcaataaatgaataccttccagccgtttcaggattggtaaaatgcagggcgaccaaaatatttgaatttgtctccctgaccgctcggcttccttcattaaataattggcacatcttcgtccaatcagtctcaccggcaaatcctcctgttgtttcatttccgacctgaaccatgccgatgtcaacgccttccttgatcatcttttgcaggctttgtttcgtatactcatagagctttgctttttttgcttcaaagctgagattcacccaggctttgggcaccttttgtttcgctggatcggcccagaaatcagagtagtgaaagtcggccagcaccttcattccgttcgctgtcgctctttttccgatttcgatggctttttgaacatcattgtttcccccgccatacccgttgccatttgaatcatacgggttattccagatgcggacgcgaacatagttgaccccagcctgttttaaggttgtaaagatgtcctgacgttttccgcttgtattataaaaggtgacaccgctgttttccaaagcaataacgctggacacatctgcccctttgataaaatccttgttcatcccctctacttttttaacaaaaagatcctctgtccgaagctctgacacgtgcttgtccttctcaatggcagcggcatatcctgttgaactacatgcactccacacgatggcagccgcaaagaacattttcactttgcttttcatgatttcatccccccaagacttagtaagcagtttcattctatagaaaaaagaatccgcccatatcgagcggagcatcagcctaatgtgtgtttacgacaattctcacttcatacttttccatcgtcaggtcgcctgacaatatgtctcctgtcattatgtccttcacactctgatcaaacgtgaccagttgtttttcttccgtaaagttcatcacaaaaatataatcattgtcctgatcctgcctcgcttgtacggagacgccttttccgtgccgaaccggaaaaactggagaaagagacaggtctgtgatcagaccctcatagaaatcacgctgaaattgatcctccaaacgcgcgccgataaaatacgccttgccctgctgatactcatggcttgtgaccgctggcgtgcgcgcataaaaatcttcttgatacactgcttccactgaagctgtctttacatcaatcacggttgcataatccttcatttcatatatttggctgcgatagctgacagcgtttcgatccttcggatacagggtgtccgtttcaagaggctcaactccaaatatagcttgaaggtccggatgccatccgcctgtgtatgttaagtcatgctcattcacaaccccgctgatatacgtcatgactaaggtgccgccgtcagccgtaaacgcttttaaacgggaaatggtgtcctcgctgattaaatacagcatcgggacgatcagcagtttatatggtgaaaagtcttgttctttcgtgatgacgtcgacagggatatcgtgttcccagaatgtgcggtaatgctgctgaagcgtttgcggataacgttttgtcgccttcgcaaacccctgagcatcctcgagcgcccaatgattttcccagtcatataaaatcgcggtttgagccggcctcttcgttccgacaacttcggacagccgttccaatgtctcgcctaccttggccacttcttgaaagacgcggttctttgggctattgtcatgatccacaaccgctccgtgtaatttttctgatgacccccgtgatttgcggtattggaaatagagtacgctgtccgagccgtgggcaatcatttgcatggatgacagcagattcatgcccgggcgcttcgccttgttgacgttatgccaattgaccgcgcttggcgtacactccattaataagaaagactgctgcttcaagcttcggtacaggtcgttgataaaaccgaccttcatcgctaaatcagctgtgctttcccagtcattgtgccagacaggataagcgtcccagctgatgacatcgacatgctttgcaaatttgctgtagtcgaggccctgatacgggatcaaatccggtgtgtcagccataaaattcgttgtgatagggatatcaggcgtcagttctttcagcggaatgatttcatttttataaaacgaaatcgtttgatcggtgacgaaccggcgccaatctaaattcaggccatgcaagccattttcaccgatcggcgaagggctttcaatttgtgaccagtcattgaacgtatggctccaaaaaggagtccaccacgcatggttcaatgccttgaggctgttgtcatatttcgatttcagccactcccggaaagcatgctggcataaatcacagtggcaatctcccccgtattcgtttgaaatgtgccacattaacagcgccgggtgatgtccgtatcgttctgctaataagcggttgatgtgccgtgttttttctcggtagactttagatgtgaggcagtggttgtgccttccgccgtgcagctgtttgacgcgggaggcattgacgcgcaaaacttccggataggtttgcgacagccaggccggacgggctccgctcggcgttgctaatatgacccggccgcctatactgtgaatccgctcaaaaatatcatccagccattcaaattgatatacaccctcctccggctcaagtgcgctccatgcaaaaatgccgacagaaaacgtattcgtatgagaaagcttcatcagtttgatatcgtcagctaaaatatcgggccgatccagccactgatcggggttgtagtctcccccatggagcataaatttcgcttcggttacgtgcgttttttcaagctttgacatcacattctcctcctttttctcttagcccttcgttccgcctgcggttaatccggacacaaaattcttttgcagcatgataaagatgagggcaaccggtatgctgataagcagggctccggccgcaaatgtcgtatagctggcccccatgacatcattcactaaattgaatagaccgacgggcaatgtatatgattcaggcgttctcaatatggttgaggacagcacaaaatctccgagcggaccggtaaagccgttcatggccacgactgccgccatcggttttgataatggcagaatgatctggaagaagattctggtgctgctggctccgtcaatcttggcgctttcgtctaaatccatcggaatggaatccatgtaccctttcatcaaatacgtattcatcgggatcaggccgccgatataaagcaagattagcagccagtggctattgatcattcccaagatttgcgccagcacaaacaaggcaattaaagccgaaaactgaggaatcatctgcagcaataaaaagagcgttaaagcgtatttcctgcctttgaagcgaaagcgcgaaaacgcataggctgtaaacgtcacacagagcaaagaccctgccattgtaaacaggctgatcttcattgagttgacataccactgcacatattgaaggctttctttgcccgcaaataattccttgtaatggtcgaatgtcggatgcttcggaatgatggatgtactgattaagctgttgccagggttaaagcttgcgcctgccgtccaaaggagaggataaacaatgatgaccgccataaaggctagcaacaagtaagagaaaaggagacggatatattttctgactttcatatctgccagcataccttatgccccctctttaaaagactttgtctgtctgaattgccacaatgcgatggagataacaaatacagataataaaatggttaaagccgcagcaagagaatattggctggactgcattgtcaatttataaatccatgaaacgaggatatctgtcccgccggctgttgatccggttacagccggacctccgccattgaatagatagataatattaaagttattaaaattaaacgtaaactgggtaatgataatcggagccattgcaatgaacaccatcggaagcgtgatgtatctcagctttgaaaagacagaagcgccatcaatcgtagctgcttcatacagatcgtccgggatggattgcaatacgcctgttgagacgagaaagatgtacggaaatccgagccagccctgcatgagaatcaacgcaagcctcgaccaattggcatctgtcatccacggaagcggatctatcccgaagaaagccaagatgtcgtgattcatcgcaccgaagctatcattaaacagtcccgcaaaaattaaaatcgtcacaaaaccgggaacggcccatggcaaaatcagaatcgtccgaaaaaaacgtttaaaccgaaggtctttctggttaacaatgatcgcgagaaaaatccccaagctgacttgcagtgtggatgcagcaagtgtccaaaccaccgtccaagccagtacatcaaaaaaagtcgacctccaaatatcaactgtgaaaatatttgcgaacgtttgaaaaccgacccaatcaattaattttgcaggaggagaatgatacaaatcatagtttgtaaacgctaatgcaaagctgaataagataggaaagatcacggcgaaaattaaaataaacaaagaggggccgctgacgacataaggatagccctcagaaatgatatgttggtattgttcctttaaggaacttaatggcttattttcatcacgctgttttccgctttggaacgcatcgcgaagattcacataatacaccgcaaggccaaagcaggtcacgatgacagcgataattccttccgccagcagaaaaacggaattatcccgcggcacttctgttcccagtgtaaagattccccaaaaccccatattgagcagatctccaaagaccgcaaaaaacgatgcgcctaagaaaagaaagacaataccttttatccattgcttgttataaaattgcccgagtcccggaatgatagaaagcaacaaagcgacttgacgatgctgcaccgttttcacctctcttacaatacaaatctagctttctctttattttccgctgtgctttgccttaatttgtcctttggccgtttcagctgcttgatccaatgcttgtttcggatctgccttccctgttgcaaccgtctgtaatgctgaatcagccggcgtccatatttcattcatttccggaatatttggtgttggctctgagaaacgggattgttcagtaacagcccgtgccgcctcgcttttcataatagccgggtcattggctagggatttcacagcaggaacttctttcgtttcttcatatcgtgttttagaatttttttcatttgccaggaaaacggctaattcttgcgccagttcttcattctttgtaaatgcactaacgttgtagcttttgacgccgataaaggagctcatgtttttcctattttccagcttcggcagtttcgtaatgccataattgattcctgctttcgaaaaagcttctacattccatggaccagaaataattgcggcggcttttccttctgtgaacagcgattccaatacgttaatcccttgttctccaataatgccagccgggaacaggccatctttgtaaaacttctgaatcagcgccgcacctttgacagctccttcattattgattccaatgtctgacgggttatagctcccatctttgtcctttccaaaaatgtatccgccatatccgctcatcacactttctgcataataaatttgatcgaatagggctaaaaagccaaaattgctgccatcagctgtctttttggaatagtcgtaccactcttccagcgttttgggcaattccttttctgtgatgagatctttgttgtaaaaaagcacagtcgtttcgaccgcttttggcagtccataaagcttttgatctaccatttgagactgaatggaagcgtcagtataaagtgattgaacgtcttttttgacatgtaattccttgagtaatccttccgtgacagcggttccgatttggtcccctggcattgttaacacgtcagggcctgtgccggccggtccgtccattcgcaaatcttcaatctgcttggcatacggtttttcaacgactttgaccttcacatcatgctctttttcaaacgcagcaacggcgtctttaatgccgatgctcttttctttatcctcccatacaacaagctctgacccttttgaactcgatttggcgctgctgctttcctttgggccgcaagccgccaaggataaactgacagctgcgcagagcatgaatacggaacacttttttgccattttcattgattgtcaccctttcggtaggaatgaaagcgctttaaagataatatagcacgcttgagaaaatgtgtaaacaaactatttacctcatagagtaaatttttttacttaaataaaaatgacttagtgtcctaagtcattcttaattcatactcttcctgacgattaattctgcgcccacatataatgtttttaccgttcttctcttgtcctgcacttgttcaagcagtaattgaacagcgtttttacataattcatgtatatcaatatgaaacgtcgtcagaggaggcgagacatacttcgcgaagctgatgttgttgatactcacaatgcttaccctgtttggtatagcaattcctttttcgttcagggcttgcagacagcccactgctatcgggtccgctgcaatcataaaagcagtcggaagctgatcgcctaatgtgtcgatcgctgctgacatcaggcggtagccgttttctacagagaatccgcgatgacagaaaatatagcgctcgtccagcatggctttttccctcatataggatctgaaggtttgttcacggatgtccatttcatcctgattggtattcggatttttgtatgtgccgccgataaaaccgatgctcttatgccccttctcagccaggatgtttaccgtcttccttgtcatttgtgccaaatcgggccttaccgagtcaaaatgatcgggatcaggagttgaatcgatgaacacgccgttttcagtgagatttctgaggaaagccagctcttcatctgaaaatgtgccgacggcaataaacccttccgtatgttcaggaatgctctcgattccatccgctattttataagtggtcatatcgacattgaatgctttcgccagtttctctacttctaatctcatcgttttaaaatagacatcttctaattcttctttatctgtcagccaatataaaaacgcaatatgtttcaccagcggccttactgtttttttgcggtaattgagcttttccgccgcttcatagattttctcccgtgtttcatcaggaacagaaaggctttcatcgttatttaaaacgcgggaaacggttgagattgaaaatcccgcttcctgcgcgatatctttaattgtcgccattgcatctgcctccattattcagctcgcattgttttagtaaaatattttactttctttttcgcaaatgtcaagtgcacaaagccctctggctgcctcatgtaaaaagactgaaccatttgcggctcagtctcagttgttcgtatcattcggaaccggcggaattgcccgggaaatgagttggttattgcacattttcctcgaaatatcccgaaagcacatcttccacattcgtcaaatgcgccagcatggcggcttccgcctctgcaccgttcccggcagccacagcattgtaaatccgttcgtgctcctcatacagccgctgaacggaggtcttcttggaaaacagccagattttcctcgtttccctcattgtttccagcagcaatgatgacacgtgattcatcaagtgtttaagaagttcattttgagaagcgtccgcaagcgcaagatgaaatgcaaagtctgctttctctcccagctccccgtccgcttcaatgctgcccatttccttcagggcatcatgaattctttcgagatctgcttctgtccttttttcagccgctagtgaagccacgccgatttcaagcagttttctgacctcgagcagctgcttgacgtcctcttttttcatcagaagggcggctgagagcggctgagaaatttgattgagctcaaattccttcagatacgtgccttctccctgtttcatttcgacaagccccatcgcttttagcgcagaaagtgcctcgcgaaccgctgaacggctgacttgaaagctctcagcaagcgcctgaacagagtccagtttatcccccggcttcaattcgccgtttttgatcatatctaatagtgcatccgctacttcttcatatattttttttgttttaatctgtttgtatttcaatgcaattcaccccgtaacttgtaggtctggctgtttacgatctattatactctgttttgtgggccgccaaaagattttgactattttgtcaaaaagtcttgtactttgatttttttcaaaatataatgctaggtaactggtcttattacccagtcatcagatgatcatatcatctatagaaaccgcttacatatggcgccagtttatgtttcaaggaggggtttgggatgcaatggacacaggcatatacgcctatagggggaaatttgctattatcagcgcttgccgcacttgtaccgattattttctttttttgggcactcgcgattaaacggatgaaggggtatacagcaggcttggccacattggggatcgcccttatcattgctgtattggtttatcggatgccggcggaaaaagcgctgatgtccgcgacacaaggagccgtatacggattgttgccgatcggctggatcattgtgacgtctgtttttttgtataaaatcactgtgaaaacgggacagtttgatatcattcgcagctctgttctctcaattactgatgaccgacggcttcaagctctcttgatcgctttttcattcggggcttttttagaaggggcagcaggcttcggagcgccggtcgccatttctgccgcgctgctggtcggtctcggctttaatcctctttatgctgcggggatctgtttgatcgccaatacggcgccggttgcctttggggcaattgggattccaattacagccgtagaagggccgacagggattccggcgatggagatttcgcaaatggtcgggcggcagctgccgtttttatccgtatttattcctctttatttaatcatcatcatgagcgggttcaggaaagccttggagatctggccggcgattctcgtatctggtgtttcctttgccgttgttcaatatctcagttccaattttttagggcctgagctgcccgatgttttgtcagctcttgtttcaatggctgcgcttgctgtgtttttgagatggtggacgccgaaaacaacattccggtttgccggtgaacaagagtcggccgcctcaattgaaacggcgcgcacaaatccggcggcgcctgcgtacagcggcggacagatttttaaggcttggtcgccatttctgctgctgacggcgatgatttccgtatggggcattccatctgtcaaatccgcgctgaccgggcattatgaaggctctgcggtgttcttaaagtggctgaatgctgttggagaaaaactgactttttccccaggtgtgccttttttgaacaatcagattgtcaatgctgacggtacaccgattgaagcggtttacaagttggaggtgcttggttcggccggcaccgcgattttgattgccgcagtgctgtcaaagttcatcacggcgatttcatggaaagactggggaaccgtttttaaagaaacagtccaagaattgaagcttccgattttgaccattgcttctgtcgttggttttgcctatgtcaccaactcctcgggaatgagcacgacactcgggatgacactcgcgctgacaggttcgatgtttaccttctttgcgcccgttctcggctggctcggcgtcttcattaccggctcggatacttccgccaacctgctgttcggcaacctgcagaaagtcaccgcattatcagtcggcatggaccccgttctgtctgtggccgccaactcttcaggcggtgtcacaggaaaaatgatttcaccgcagtcgatagcggtggcgtgcgccgcggtaggactcgccggaaaggagtcagatcttttccgctttaccattaaacacagtctgtttttgctgctgctcgtttgtatcatcacctttttgcagcatcacgtattcagctggatgattccttaaaaaaatcctcccgtctagggaggattttatttatatcgctttctcgctgccgatgacggaatattcatttgatcgcgatattttgccacggtgcgtctcgagatttggatgccgtgttgttcatacagcaaatcgacaagcttttgatctgaaagcggttttgttttgtcctcttgattgatcaggtcttcaagatgcattttgactgcataattcgacgcatctccctctcctgaagcctcggcttttgctgagaaaaagagcttcatctcaaacagcccgtaaggcgtttgtattgttttccctttaatggcccggctcacagttgattcatgaaggcttagacagtccgccacctctctcagagtcagcggcttcattgcgcttcgccctttcagaaagaaatccttttggcgtgtgatcagttcattgataattctcgtgattgtctgttttcgctgcctcagcgcgcggctcagccagcgccactcctgatatttcgcagataaataggagacagtatcctgacaggagccggatgataaaagcgttctgtactgcggatgcagatcgatctcgggaaacgagcgggtattcagttccgctgcgatgtgcccgttttttacagtgataaaaatgtcaggctcaatatacacatcttgctctggccgggcaaacagaaggccaggtctaggatgaagagccgcgatatcatctgagatatcttgaatagtatgaagcggaattcctgcctccactgaaagcgctttccattttttttgcgcaaaagcatcaaaatgagctgaaaccagcatttccgcttgttcatttctgttcggcagccgctgtaattgaagaaggatgcattcctgcaaagatctcgcgccaattccagccggttctaatgactggagttttgccaaaacagcctccgcttccttggccgatacagataatcgccgtgctgcctcctctatatcttcttccaagtacccgtttgaatcaagcgaatgaatcagataattaaaaatctttttttcagtgtttgtcagattcatatcgagtgactgctgttttaacgcatcctgcaatgttttttgcggattacttaattgaaggcccgcttcctgtgcattcatcctgtttttgtttgttttatggtaagatagtggcggtgtgtctgtttcctttcgttcaataagagggttttccagtgagagctcatcaatgtactcggcgagttctgccgaatgatagccaagcagcgtgatggcctgcctgagctcctgtgtcagttgaggctttaatacttgtacttgctgaagtttcatatccatcttgctcactcccctttcttcattgtacatgattgagatcacaccgtatacatttatgaaaaaggagctgccaaagaaatgtctgaacttttttccgtcccttattttattgagaatttaaaacagcatattgaaatgaatcagtctgaggataaaatccacgcgatgaacagctactaccgttccgtcgtctcaacactagtgcaggaccagctgacgaaaaacgcagttgtcctgaaacggattcagcatttagatgaagcatacaacaaagtcaaacgtggagaatcaaaataaaccttccgctcacatgtgagcaggaaggttttccttctttgaggcgtgctggatgagacgggtgcttggcacgccttccatccaggtatgaaagtaattggcgtttttcccgtaggaattatcaatgaccgtgttttctttttgaagaagagaagacaggatgtggccgtgcaacctcgatgtttccaccgattcgtaacggctgaaaaaccgaatcgctttttggacgatataatccgagtatttttcccatatatacgcaatgggcaaagggttgcctgcttttttattcaagacgttcagcgtttggagaaaagcaatcgtccggcggtctgaagctgacagcaccgtgcgccagtcgtagctttccgcttctgcgtgtccctgaagcgcctggtttgcttcatgatctgttcggataaatctcagtttttgattggacggctgctgcgtgggaatgacgggaaacagctgatgaaccatatcaggcagaagctgaatgtgatttcttgaaaaataagcctgtgccgtagcataggaggctttttcccttgtcataatgtgaaggttcgcatgcttagaaaatatctctgccgtccgtttgaggttgtctttgttttgaaaataaatcgattgcggcaggatcacaattttgtggttcggataggtttggacgattttctctctaaagccttgataatacggatacagatccccgaagtttccgcctccctggcagacgatgatgagatgaggatccagctttcgcccgactggaaaattgtcaggattccagcgttttctgacccgaatcccgtgttctttaaagaaggcttctgttcctttcataataaataaatcccctacattcccatatagaggatagtcagcatatataatctctgattgtttcggtatgacgtcgagcagcccggacagtttctgtttcaggctgatcatcgaatgcttgctgtccatttcttcacctcggcagtttggaataagtgcagtagcacttcaatgacccggtcttgctcatcttctgtcatattggaccccgatgggagacagattcctcgcttgaacaaatcttcgcatacgcttcctgtatcttcatgagaataaaataaagccggatcgaatagcggctgggtatggagcggcttccacagcggacgagcttcaatgttttcttcagcaagacgttgaactacgtcatatgggctgagcccgttatcaagtgtgagcgtggtgagccagcgattggatacgcctgctgcgtactccggcataaagcggacgccgtctatgtgaccgagcgcattgttgtatctcgtgaaaatggtccttcttttctccactcgctcatccagcacctcaagctgggcaatgccgacgccggctaagatattgctcagcctgtaattatgaccaatttgactgtgttgataatgaacagccggctctcgtgcctgcgaagcgagaaatcttgctttttcaattgctgcttcatcatttgaaacgagcatccctccccctgatgtggtaatgattttattcccgttaaatgaaaaaatgccgaagcgcccgaaagttccgctttgcttccctttatagactgtgccgagagattcggctgcgtcctcaatgacaggaactccgtatgcatcacacaggcttacgatttcatccattttcgcgctctgcccatacagattgacggcaatcaccgcttttggcagtgttccatttcttttcacttcctccaatgctctttcaagggctgtcggcgacatattccacgtatcaggctcagaatcaataaagacgggcaccgctttttcatatagaatcggattggcggttgctacaaatgtgaaggactggcaaaacacgctgtcaccttcttttacctcaagtaaacgcagcgcgagatgaatcgccgccgttcctgagctgaccgcagctgctgcttttacaccgactcgttctgccagctgttcttcaaatgaattcacgagcggcccaagcggcgcgatccagtttgagcgaaaggcttctgaaatatagtgctgctccctgccgctcatatgagggggagataagtagatttttttatgcatagaatcatcctttgtttgatgtttgaatggaagaaatgatgcgtgccggagcaccggccgccgttaccctgtccggtatgggacggatcaccgcggagccggcgccgacaatgctccaagccccgattgtgatctgcggtatgacggatgcaccggttccgacgtgagccccttcctgaacggaaaccgctcctgacagcgtggcacgcggagacagatggacataatcgctgatctgattgtcgtgctctgccactgcacccgtattgatgatgcaatgagcgccgatgcgcacatccgcctgaatgatcgcgcccgccataatcactgtcccttccccgatgacagccgacttgctgacgatggctgacgggtgaatcaatgtaataaaatcatctttcctcagacccagtcgctccgccagctgttttctgacactgttattcccaacagcaatcagaaacagcacatcaggaatgagcctgcgcagttcagtaacggcttccggcggtcctgtgtaccattcttttccgccttcgaatgttttgaatttatcatccagcaccgcggctaagcgcgtatctgagcgggcgtttatcagctccctgatcacctttccatgaccgccgtcacccacaatggccacgtttttcatgaggacacatctccgcttccggtaaaccgttccgcggtcacatgattggtttgctgaatcccttctgaaacaaggacctttcgcaccgtcaaacataaaattttcaaatcgagaaaaaatgaccggttgtcaacgtaccaaacatctaattcaaatttcttttcccaggaaatcgcgtttctgccattgatttgcgcccagcctgtgatacccggcttcacctcatggcgccgtgcctgtttttctgtataaagaggcagatagtccatcaaaagcggccgcggcccgacaaggctcagatcgcccttcaggacattcaggagctgcggaagctcatcaatgcttagctttctgatcagcctgcccgttttcgtcagccggacttcatcgggcagcagatttccctcactgtcccgttcatccgtcattgtccggaacttgtatagggtgaacggtttgccgtgcaggcctggccttacttgcttaaagaagacaggtgatcctattttcagcctgacaacggcgatggtgaacagaatgatcacactcgtacagcacaacaaaaaaatggcggccgtcagatcaaaaagtcgtttcaggatcaaagattcacagctcctttcgtttttcgaaaccgttttagtaccagctgtctttcctcttttgtacaaacgagcataaaagcgaaaacagcgtagcaaaagctgactgtcactcccgtcgctatcagtgacggccatccgtcaaccttcacaacgaactgaattgccttacagaccgtccaggcaaacacagcggctgatagaggcccgattatgcctttaaagaaaacgtgctttttgtagcctgtaatgcgggatacataaagcggcgtaaagatggcattttttaaaataagagaaatggcccctgccaacgttatgccgtacagaccgagatgagccggcccgctcagcgtgaccgccagcaccacattcaccgcacctaacagcagggtaacaatcgccggtgttttttgttgattaaaagcggtccatatataaaacagcggcataaaggcgaggctgacaaccaagtatccggcatgaataaataaaagcggtgctatcgttgaaaaggacggtccgagccagattgtcaaaaaaggtcccgccaatccgcccaataaggcagcaggaagtgcaagcaaaagaccattgagccttactgccttattggcgtaattcatcaacccttccatatcgccttttgaataatatgaagtcatgataggcgcaaacagggatgcgaccgttccggccaagctgcgcaaaagcagcggaaactggataatcgccgcgtatttcccggatgcggacgcccccagcatcaaattggcggttaacagatcaatctgcaaaaaaagcaggacgccgatttgattgacggagctccatgcgcccgcttgaaacagctccttgcttgtgcggaatgaaagatccttcatacgaaacgaaaaccacggaatcagctttttgaagaaatagaaagacagcacagacgcaatgacagcaccagctaaagctgcaagctggatctgccagattttcggcgcaaagcatgcaaacaggagcagcacagacagcacccgtataagcatttgcaccgcctgaatggaactggtgatataaaggcggttggcataaaatggtgcagcaccgaaacccgccatcagaaacgttaaaataaacagcacactgccgattaaaatcgacaaacgcacatctgccaaaagcgcttgcggcacattcatgacgcggtcaataaaaaaagccgaacccgcaagcggcagcaagagcagcaatgaaatcaaaacagaggccgctaaataattgctgatatacgcatttgctttctcccgctctcccctgtgggcagcaacagaaaagaaccgaacgacaaccgagctgagcgccacggtaataaccgaaaagtaattaatcacattttgtgtcaagtgaacaaagccaaacgcttcgacaccgagcgttttgacaataaaaggcgtcatccaaaccgataggaaaacagacaagagaaaagccgtgagattcgcgctgaaatttatcgtgaatttcatgcctgcttcgcactgcctttcattgtcccccgctgctcgaaaaacagcttgatgagaaaagtgagccgccatttacacagtgctaataccaaacgctctcctcttaataatttctcatgctgaaacggtgtatgtctgacagcctgccgcaccatgtcataggataaaatctgtctgatcttctttttgatgtctttcggcgaattcggagaagcacaggcatttgccaaaagcatcggaagctggtgcctgcaaatgtacacattcaaatcttcttggcatgcgcctgctaagccatagtgattgtagaatgcgattttagcttgatattgtttttgaagatgttcatccatcgccggcttataagggatttctgtcaggctgttcgggttttcacgataaatgtacaatccttcatcaagcattttcacccgctccgcttcgcaaaaagcggacaaattgaagggagagtcttcagcaaaacggatgtcttcagcaaacagcagattcgccctatcaaaaagctcacggcggtaaagataacgccatacataccagataaatctcgtttcgtgagcatgtttaagctgttcagtcatttctcgttttgtcagcacgcggtttgcctcaagctgcggcggcacatatgtccgcctgtccgatgactgtttgtaaaaaccgcatccgacgatgtcgagccgattttcctccgcttcttcagccagcctctggaacatggcggaaaatacataatcgtctccgtctacaaagccgatgtaagtgccccgcgcggcctttattcccgtatttcgcgctgaactaagcccgccgtttgcctgatgaatgacccggattctcgcatcccgttttgcataatcctctgcaattttgcctgaacgatccggtgttccgtcattcacgaggatgatttcaatatcagaaagcgtttgacgaagcaaagaatcaatgcactcccctataaatggttcaacattatacatcgggacaataatgctgacgagcggggtcattgcgcttcaccgctgattttgtcacgcagacctttaaaatacacatctctcggaaagcctgcacgggatgtttcttttgttaaaagctcattgactgcggctgttacgcgctctggctccggatgttctatcagcttcatgaacgggatgtctttaagccattgatagccctccatcaccttatggtcaaaggagcgaatgacaacacacggcgttcctgtcagcgcgcaaaaaatcatgccatgaagcctgtcagtgacgacggcttctgcgctttgcagcttagaccacagtgcttcaagttcttgttcgcgtgtatcgcggctgacccggcggccgatcgttgtcgtaaaggatttgatctcgccgaattcctcacatagcgcagccttgacccggttcctctggtcctcctgaagcacgctttcctgatcctcgcgcaaacacatataaaccccttcgcgttctgcgggggtcttgcttctatctaaatacagcaccatgtccggctgcttcaaaattgttttttcttgaaaatgctgtttcataaattgatacgttgtttcatcccgcgccatcagcaacaggccggggtgcgcattataaattttctgtgcccgtttcagctctttgcgcccttttttcgtgtcagaaaaatgagccgttgccggaagctggacaacccgatagtcatggaatgttttaatgatgaagcggcgcgtccactcctcataacggtataaatcccccatatttccgccgccgatgataaagaccatatcctccggatggcgcgagcggatcaggttttttgctgatttgtaaatgtccttcatatcgacctcgacgatgtcaaagtccgggtattcttgctcaagaaatgccttgctggcataagcaattgcgtgatctcccaaattgtcatgggacggcagcagggtcagtatgatttttttctgatgtgctgcggcctttaccggttgatctgccgctcccagccaatattgggacgggtatttgacctttagcagcagccattctgcaaaattgattttcaacgattgtaacgacatgtcctcaccctctgtttctcattttgtactcgatcacccgctgatacatagccgatgccatagcgacgaacggaatcattctgtatttcgccatcagaagcaggcatgaccgttttgcgtcaaaaggagcggtacccgtttttgaaagactttcttgaaacaccgggtccgcgcatatcacgccaacatttctaagcttttcaaacagtcggcggctgccgctcgttttccattcattcagcatgcagatgctgctgtgaagaacgataaaggtatcaagctccttgcgatactcctccagtttgttgttctcctgtaaaaacgccgcattcgcctcatacagcgcaagtcctgattcaaacaattttttctgatagcgctgcacaatggaggaaaggtgaattcggtaatgatagagcggcgtttttacgtaggatactgagcgggcgaaaaaatgagccctgaagctgaaaaactgatcctcgacatgctccagctcgcctcggagcggaaacgacagccgatgggcttcaatcatgcttcttctgtacagtttgttccatgaaaaccctctgaccttcccttcgaataatgccttgatatagtgctccttcggctgatcctgataggtttgggcaatgtctgagtccatggttttgccagtgtcctcaaactctgcggcgtaattgcaaatgaccagatcagtttcatcgcctgctgcccggagcatctgctcgcaataatcaggttcgatccaatcgtctgaatcgataaacgcgataaattcgccgcgtgccgcttcaatgcctttattccgaaccgcaccgagtccctggttttcctgatgaatcaccttgaacctgttgtccattttggcgtattcttctgcgatatccgggctggcgtcagctgaaccgtcattgacaatgatgatttcaatattgtccactgtctggttccgcagtgattcgagacacgttctgatatatgtttctgtgttataaacagcgactaacagactaaccgcaggtgtttccataatgaccggctcctcgtgcataaattaccgggaaaaaatcgttctgtaaggcagaaccgatgaatcaaccggcataagcaaataactgtaaagaaaataacaaacaacgatagcgatatagataagggcgttcgatttttcatcaaatatcctgacaaaataagggactaagatcatttgatacagaccgaaataaatattgaatctggcaaaaatcacgtcctttgtggccaaaaggccgaacaaaaaaccaagcaggcacaaattgacgacaatatcgatttgcggccacagactccgcaatcgttctttatagcaaaatgcaaggaacagcggcagaaccaaaacagcgattttgatcacattcattccatttgtgttcgtcatgagccatttttcataatggctgtatgagctgttttcaagtacaacgacaaacacagaaataaatttttgatataaaaatgtcatgccgagaaataaagcggataggccgaatatcgccggagaccaggcttttcttctgacaataaagtacaccggaatcataatcagcgccgacgaatgaaagagcgagctgacgagcacaatcaggaaatatcgcttccagttcccgctgatgatataacggatcgcccaaaacaaagcagctgccaccatgtattgcctgatgccgttaaaagacgcgtagtaatgaaaggttcccaaaaacaaaaagacactcagctcaaacggcctgccatagtcggcgagtgtcttcataataaagctgtaggtcacgaccgccaccgtaaaatacatgatttgaggatcttccgtgatgaaattcatcagccaaaggagtgcggtaaaccccggatctgtcgctgttttcgctgtgccgaaaccgaatatctgccacacattttgataatcgcccgccaattcgtacagcagcgtgtacgtctgaaaatccgtgccgactcgatagcggagacctgacacgagcacaagtgaagcgagcggaatccagatcaaaagcttattcggccgataccccgtggcaagcgaatcgtcacggccgccgcacattttagcgaaccaagaccaaataaatacaatccccatattgacggcatatacaatcatcggttatggtccttttccgtgctgatgttgtatacattcagcagcgctcctacattttgctgtgcatcgtagccaagttgagcgagtgtttctttgatgaactcacgcttcggcctgcctgcggcggccgcccttgcaatggtttcagcccagacgctgatcggttcagaaagacttaatcttgtgacaagcccgagaccggcgtcgactttttctgtaatgctgcctgaaatgatgcatggaagccccgacgcctgcgcttccacaagcacaaccggcaagccttcgtacagagacggcatgacaaacacatcaaatgtgcgcatcaattcatggatccgttcttcagtgcctaaaaagagaacatctgatagcagattctgccggcgcgcctcctcctctatctccccgcgcaacggcccgtctcccgccagaacgagctgaaagcgaacgcctctttccttgagatgtgcggcaagcttcagcaggaacgcgtggtttttcacttcatgaaaccgggccacatggccgatgatgagccggtcggctgcaatgccgcgtgctgctttttcttcatcagccgcctgcccatttggggcgaacaactcaaggtcaatcccgttaggaagaaggtgaacacgctcccgctccatattggactgtccaaataaaaacctgcccgcatcctctccgcaggcacacagcgctgtcgcatttgccaaaatgagccgcctgaacacgagcagctgcaagcgatccttccagttgaagccggtcttccaagacgtattgtgggaatggcataccctgaccggcactccggcgagccttgccgcaagggcgataaaacccgtttggaaatccgtgtgcgcatgaacggcgctgaacggcccgttttcttttatcgcttttctcacattcctcacaaatgtaaggggattgctttgcccaatgctcgggacataaaaaagacgcccgcctaaagataaaatctcttcatcataagcgcacggatcatttcgatacgttaaaaaatcaaattgcactttgcttttgtccatcttccgatataaattcattaccatggtttccgcgccgcccctgttcatgccactgagaacatggagtacgcgcttttggctgctattcatgcttgacaagcccttccttttggttcatcactctttttttatggtagcgattcatcacggctgcaggcataaacgcgcggattaacggttttgcgatatatatgtaatcagataaaggaagcttcaagcgtctgcacgcctgatagacaaggatggcattgtcaattgaatacgtaaatgaccgccgtttgaatgcatcgctgtcttccctcactttatacaaggcttcctgaagattatagcccctgaagccctcttcaaaaaagcgaagccacaaatcaatatcttccattcgtctcgtccgccgcaccgaccggtagcctttcagcgtgcggtaggcactcgctctcatcataatcgtgccatggcaaaatggggtcccttttgccatgatgcccggctccggaacagaaggcagaatgcgggcgcctcttacgccaaattcatcaaacacaagcatgccggtgccaaccacctgataatgtcggtgcttttctaaaaacgcgacctgcttttccagacggcgcggaaacgaaaggtcatctccatcctgacgtgcgatataatcgcctgtcgcatgcgaaagacaatgatttaatgatgcggcaagccgcttatttgttttgttttgaatcagtttgatgcggtcgctgtaatgagcggcatactgcttcgcgatgcggagcgtgccgtctgttgacgcatcatcgcacaaaatcagctcccaatttttataggattggctgagtatggattctatgctttctgccaaagtgcgttcgcaattataaatgcccataatgacagaaactttcggtcctgagttcatacgcttttctcctttgtatccatatccatgtacgcggaataaatatctgccatttcttccaccgttcgcgcctccgagaagcgcaaggctgtttttcggccttcctgtcccagctttcggcagagctccggcttatggtaaagctgttcaatccggcgggcaaaagcagcactgtcaccgattttgaccagaaaaccgttttctccgtcgcgaatgatttcccgatgcccgcgattatctgtggcgatcgccggtttttctgccgccattccctcaagcacattcataccgaggccttctctaatgctggatgcgacagatacatccgcaagctgaatcaactcatgtatgtcgctgcaaaagccgtaaaaacagacattggcggaggcaccaagcttttcagctaacgtttgatacgtatgttccattgccccttccccggcaaacacaaggcggagtgagggaattttttcttttagcaaggctgcggcttcaattaactgcttctggtttttgttcagattgagctcagccggataaaccaatataaaatcatcttcacggaacccgtgcttttctctgagtctttgctgctctatcggactgacaggccggaaacgctcggtgttgacgccaatgccgtgaattttctgcgtccttccgcccggcctttgaagtcctttcgcccgtatgtaatcctcttcattaatcgtaatcaggcagtctgtatatgctgaaagccatttctcaaccggatagtaaagaagccaatttttcatcggtgcccctttgcagaagtgaaatccgtgtgctgtgtacagcacctttgttccgtgccgccgtgcctgcctcgccgccagtctggcgagaacgccgccgaccggtgtatggcaatggacaatgtcgtattcataggtgtcaatcactttcttcagctgcctataaacggccaggttctgagggtcaaaaggtgacctgcgaatcgggatggagaatttctcatccacatacggcagcttggtttgtccgttcgcagcgacatgaacctcccagcccatttgtttgaaccatttaaaataagggaggtgaaaggccttaaaatgataatcaacagtcgcgcaaaacaatatctttttcgtcattttcactccccctaatgaacgctggcagccgtcatttcttctgatgtattgattgccgcaaacagcctcgctctcaggtcggcttccggcagctcatgaaaatcctcgataaagcgcatcagcaccggccaatcgccgtccaccgctttaccgatgtgaatttttggaaagatttgttcagcatggacttcatttttgttcagcaattcttcatacattttttcgcccggacgaatgcctgtgaattcgattggaacctgctcagtcgtgtagccggacaaatgaatgaggtttttggcaagatccacaatctttacgggctctcccatatcgagaacgaaaatctgacgccctttcgccagtgccccagcctgaatcacaagccttgatgcctcgggaatcgtcatgaaatagcgggtcattgccggatgtgttactgtcaccggaccgcctttttcaatctgttttttgaaaattggaatgacgctgccgcggctcccgagtacattgccgaagcgaacagcgacaaatttggttctgctgactttcccaagattcataataatcatctctgcgaatcgttttgtcgcccccattacgttggctgggttcaccgctttgtccgatgaaatcagcacgaatgtctctgttcccgacatatcggctgcttccgcgacattttttgttccgataatattgtttttgaccgcctcttctggattgtgttccattaaaggcacatgcttatgggcagctgcatgatagacaacatgcggctcgtattttttcatcaaggtaaacattttatcgcggtcctgcacatcagcgatttccgtatggaacacaatgtgtttgccgaatcgtccgttcagctctgtataaatcgaatgaatgctgttttccccatggccgagcagaatgatttccttaggctgaaacgcgctgatctgacgacagatttccgagccgattgatccgcccgctcccgtgacgagaactgtttttcctttgatgcggttcgaaatttcgctagtgtcgagggttaccggctttctgccgagcaagtcctcagcttttacatctctgatttgtccggcagttcgtgtgccaagcagcatttcatcaaaatgaggcataattttaatgtttactccggttcgcacacattctttatataacacctgaagctcatgggtgcggagtgaaggaatggcaataataatataattaattttgagcttttgcaccgcaggcatgatactttcttttccgccgattacgggcagccccataatttctaatttatgcttcgtttggtcgtcatcaataaaagcgacaggtatgatatcaggttcatctttcgaaagcagctgcctgaccatcagagtcccacctgagcccgccccgataatcagcgcgcgggacgaggcgcagcgttttttcctgatgctttcgtttaatactctggataaaatacgggtccctccaatagacaaaagctgaagcacccagcacgcggttaacagacggaagaacatcgtgtgatacacagcatactgaatgacgccggtcacagcggctgaaagcgtaatgcccttaagcaggacaatcagctcgccaagcccggtgtatgtccacacctgtttatactgattgaacaggaaagcacacacatgatagctgagaagcaagctgacagcagtaagcagtaatgctccggagtcataaaattgataggaatcttttaaaaattgatatcctgcaataactgaatttaaaacgaggtaagtatccagcgcaataatcattgacagtcttctccggtaactcaaccttttcccccctaattcttttatcggtttagctgcggcggttttcgtctctccaaaaaatcggcagcagctaaaccgacaacacgtcctatgtatatatcagataagtgggcatttaacccatcctcacgccccgccagcgacgaccagcatctaaggcagcaacttcagctgcccacagcagagccgagtgcctccattgatacaggtcaggagacatcacctttacaaaaactagtaggaatagtgttccgattttttcattttctttttgtttaaaagagcgcctaacagcttcgcattggattgttccagtgcatcctttgctttcagaacggtatcggtttttgtttttccgcttaaaacgacgagcacgctgccgtctgtctgatttgctagaatctgagcatctgcaacagccaaaagaggaggggaatcaaagatgacgaggctgaattgttcatagatctcagatattaaatctcccattgcttttgaagacaacagttctgccgggtttggcggggtcggcccgcttgtcagtacatataagttatcgatcggcgtcttttgcaccgtctcactgagtgaagcattgccgaccagcacatttgtcagcccggttacattatcaacctgaaacgtctgattgatggtcggctttcttaaatcggcatccaccagcagtactttcttttcctgctgctgcgcaaagacagccgcaagattcgctgcactgaacgatttaccttcaccaggcacagaggaggtgacgaggatagatcgcaagttggtctggacagatgagaactcaatgtttgtccgaatggtgcgatattgttccgcaacaactgatttattgtgtaaaacagatatttgagccaaacctcgccttgctttcttttttctaaagatcactcgcttcactccccgaaatgttttatcccacgattccgccctttgtggacatcaggaacggagcctaagcatggcaatccggttctctcgctgagctgccgtgcgcttttgcaagtatcatcgagaaaatgcagaaaaaatgccagtgtaatgccgcccatgacagcagcgccaaaagccatgaccatatttcgcagcctggccggcttgatcatcgggctttcagaagccttcgcctctgataatatatgtacgccttgtacattcattctttcatctacttctttttcaaacttgttcactaacgtgttcgcaatctcagccgctttcgccgggtcgtgatcctggacggcaacgttgataatttctgattcattttcactgctggtaaccacttttcctttcagcgaggaagccgattcagataggtgcaattccgccttaacttcttccatcaaggcagtgcttttcataatcgattggaacgtgctgctatactgaagatttcgctggatgtcactgagattcgagttttcttcaccgtctgattcatgaaccagcacctgtgtcgacgcctggtaggtcggtgaaatgaccttaaattgcacaaaacccataataagggtgacgccgattgtgatgagcagaatcagcacgaatctgtgtctgacaatcgcatataattctttgaaactcatattctcattcatgtattcatagccttcagccttcccgcggctggcttcccgcgcccctttctgttaatgattggattataaaagaaaacgttattatttaaaaattgcaaaataagccaataagttctctttagagaacaaaatcatgattttcctctaatttactgcacttcccttattattttaaattttataaagaacgaaaaattctttataatgaacaaaataacgacaggaatagaggagaatttcatattatgattggaagaattatccgtttgtaccgtaaaagaaaaggctattctattaatcagctggctgttgagtcaggcgtatccaaatcctatttaagcaagattgaaagaggcgttcacacgaatccgtccgttcaatttttaaaaaaagtttctgccacactggaagttgaattaacagaattatttgacgcagaaacaatgatgtatgaaaaaatcagcggcggtgaagaagaatggcgcgtacatttagtgcaagccgtacaagccgggatggaaaaggaagaattgttcacttttacgaacaggctaaagaaagaacagcctgaaactgcctcttaccgcaaccgcaaactgacggaatccaatatagaagaatggaaagcgctgatggcggaagcaagagaaatcggtctgactgtccatgaagtcaaatcctttttaaaaacaatgggaagatgatgatcggttaagggctaacgttcgcatctatagggtaaatctgtttataatgggggaaaaagggagagaacacaatgactcatcaaatagtaacgactcaatacggcaaagtaaaaggcacaacggaaaacggcgtacataagtggaaaggcatcccctatgccaagccgcctgtcggacaatggcgttttaaagcacctgagccgcctgaagtgtgggaagatgtccttgatgccacagcgtacggccctgtttgcccgcagccgtctgatttgctgtcactttcgtatactgagctgccccgccagtccgaggattgcttgtttgtcaatgtatttgcgcctgacactccaagccaaaacctgcctgtcatggtttggattcacggaggcgctttttatctcggcgcgggcagtgagccattgtatgacggatcaaaacttgcggcgcagggagaggtcattgtcgttacactgaactatcggctggggccgtttggctttttgcacttgtcttcgtttgatgaggcgtattccgataaccttgggcttttagaccaagtcgccgcactgaaatgggtgcgggagaatatttcagcgtttggcggtgatcccgataacgtaacagtatttggagaatccgccggcgggatgagcattgccgcgcttctcgctatgcctgcggcaaaaggcctgttccagaaagcaatcatggaaagcggcgcttctcgaacgatgacgaaagaacaagcggcgagcacctcggcagcctttttacaggtccttgggattaacgagggccaattggataaattgcatacggtttctgcggaagatttgctaaaagcggccgatcagcttcggatcgcagaaaaagaaaatatctttcagctgttcttccagcccgcccttgatccaaaaacgctgcctgctgaaccagaaaaagcgatcgcagaaggggccgcttccggcattccgctattaatcggaacaacccgtgatgaaggatatttatttttcaccccggattcagacgttcattctcaggaaacgcttgatgcagcgctcgagtatttactagggaagccgctggcagagaaagctgccgatttgtatccgcgttctctggaaagccaaattcatatgatgactgatttgttattttggcgccccgctgtcgcctatgcatccgcacattcccattatgcccctgtctggatgtaccggttcgattggcacccggagaagccgccgtacaataaagcgtttcacgcattagagcttccttttgtctttggaaatctggacggattagaacgaatggcaaaagcggaggttacggatgaggtgaaacagctttctcactcgatacaatcagcatggatcacattcgccaaaacaggaaacccaagcaccgaagctgtgaattggccggcgtatcatgaagaaacgagagagacgctgattttagactcagagattacgatcgaaaacgatcccgaatctgaaaaaaggcagaagctattcccttcaaaaggagaataaatatggggaaaacaggatacattggtgctgccattgttgtggcagcttgtatcattattttgtcggccgtggtatgtttacgggacacagtctattaccagcctatgcgctggactggcatcatactgtttttcgtgggaattgtgatggttcccgcatactcagcaaaaagaaaacccggaaaagagaagtaattctcttttccgggtttttatgtttattataatcttcccgcgcgaatatcgtctgtcattccctcataaggagccttcgaaatcacttcttcgttgtcgactccttcatttttcagaaatgtaatttccgcaaattcaggtacaacgtattttggatacgtttcatatttttcgcgggattcttccatcaaatcaatgtggtcattttggtagcaaaccgtaatttcaggatgttcatgcacccatttcgggaagaaaataatgccgtgcatgcgtttttcatttggcataaagtttaatgaaacatccgtgccagtcggctctgtccaagacactttatatacgccttctgtcagtttgacaatattcacttcctgatcccgaacccagcgtccggcaaccattccgctatgaattctataatcaattgtatggtcatttttaatataaatctcgtattcccagccgttttcatacgtataaatcatgtggcttccgataaagttttccatttttcacactctccttagtcttttactgcacttcataaatgtctagtcgaacgtaatcaggggttctttctgcggaaccgataaacaagcggtcatggagccattgatagactttactgcctgtttcaaacgtcggtaccgtacgaaaataaacatgctccggatcaatgatttccccggctgccgcttgttttcgaaacggctcgctgacttgccgtattccattgttttcaatgtaaatcagttcatgatctgctgtttcgatcacatacctggcagataaatcgtttctgccgtcagcgcgaatcatttgcgaatcggcaccgctcggcaaaatacgtccctttacttccccggttattgttcccgaacgaatcggaatgaatcgtctcagtcccaggcctgtctcaccaatcgtgataggcggatcaaccttgatttctaaagaggcgaatggttttaaaaccggcttcttcacgagaaccacctcacctccagaaaaaatcatgtaactatttacatgtttaatttaacactattgcagttaactgtcaaacaataggaacataaaaaaacaaggactgtttgaagacagtccttgtctgaagctagctttgataagcaagatatgtgctgacagtgcttttggcaagacaggcagaggaatctataatcggaatctcactttgaatatgatctaacaccgcatttaaatccgtgcaggctgaaatgatgatgtctgcatgctgactgatttcttcatatagcgtctgccacaatgcttgtgtatgctgcatatgatttggctgtttgattgcggcgataagctggttcacagcctgctgccaatggtccttgtgaacaacttcttgtccatttgccttcagaactttttggtagatggcggattggatggttggctctgttcctaaaaccaccgctttttttgcaggatgcggaatctcttttatcgtttcctcaacgatatgcaacataggaaccgacaatgcctgctgaatctcttcatagtagacatgcgccgtattacaaggcagcgcaatgaaatccactcctgttttctcgagctttaccgctccgtcgataatcgcttttttcatctcgtcatggtcaattggacgatctgcatagaagggcgtcgggcatgaatagatcatcatgtgcgggtagtcaatatcgtttgaagccccatacagcttctgacagtaatcaatcaccttatcaataaacggcgaggtcgatttcggccccattccggctaatattccgatcatcaaattcattcctttctaatttgtacggaccgcttcttcttctgagccatcctcatagaggataaagcttttcgcagcatccccgcctaacataaactcgacttcaacagacaatgctcgcagaaagaaacgggtttccgaggaaggaaataactccagtctcagctgtccggtgatctccaaataaagccgttcattctcggctgtcacctgtgcagccgttccatcctgcaacaggtagctgccaacatagcggctgtatatcgccgtatcaattgcttttttctttttatcagcaggacgttccgggacctcatatggctggccaaatagaatatgttccgccgccttcagaatcgcttgttcatattcagtatcctcttccttattactcaaatagatcagtgttttacgatgatcgatatatcggatcatcaacgtcgaatagccgggccatcctccgctgtggctgacaatccgccctttttcaggactattttgcagtacccagccaaagccataatcaattgtttctccattgttgaggcgcactggagaaaacgcagattccttagaagccttgctgatgaaatcgtcctgatataaagcctgatcaaatcgaaacaaatcgcttgtgacagagttcaccgtcccatctccctgtatgccatcgagatacacaacatagttcgtttcctccagctcatcagggaggacgtatgtttcggaatgtacatcatacacatatccatatgcataatgatcaattcgctcaggcgaaagcctcctgttatacactcttgtttcattcatgccgatcggtgaaaaaatacttgttttcataaaatccgcatagctcatgccagatgctttttcaatgataaccgccagcagcacataccccgtattgctgtacatccagccttcattcggttcaaaataaccagatagcccctcattcatcagcatatcgacaatatcctgattcaccgcaatcttgtgtgaatcccaattggcaaaaaaccatcccatataatcaggaagccctgacgtatggttcaataaatgccgaatcgttacgccctgatacggaaaaccgggcagccagcgatccactttatcctcatagccaagaatccccttctcctccagcaagatgattcccaatgctgtaaaaggctttgacaaagacgctaactcaaacaaagagttggttttcaacgggcgtttttccgtcatttccgcatagccaaaagagtggtgatataaaatatcgccaccctccgcagccagaaccgtcccgttaaactgatgtttttcgcctaatgtctcaaataatgtctgaagatgctttcttttattctgtttcattcctccacctcccatatctctgtacgttactaacctactaacgtttcaaatattttgaaaaacccttcagttagagatcctttttaacccatcacatatacctgcggttcactactatttagtgaaatgagatattatgatattttctgaattatgattaaaaaggcaactttatgcccatgcaacagaagctataaaaaatacagagaatgaaaagaaacagatagattttttagttctttaggcccgtagaccgcaaatccttttatgattttctatcaaacaaaagaggaaaatagaccagttgcaatccaaacgagagtctaatagaatgaggtcgaaaagtaaatcgcgcgggtttgttactgataaagcaggcaagacctaaaatgtgtaaagggcaaagtgtatactttggcgtcaccccttacatattttaggtctttttttattgtgcgtaactaacttgccatcttcaaacaggagggctggaagaagcagaccgctaacacagtacataaaaaaggagacatgaacgatgaacatcaaaaagtttgcaaaacaagcaacagtattaacctttactaccgcactgctggcaggaggcgcaactcaagcgtttgcgaaagaaacgaaccaaaagccatataaggaaacatacggcatttcccatattacacgccatgatatgctgcaaatccctgaacagcaaaaaaatgaaaaatatcaagttcctgaattcgattcgtccacaattaaaaatatctcttctgcaaaaggcctggacgtttgggacagctggccattacaaaacgctgacggcactgtcgcaaactatcatggctaccacatcgtctttgcattagccggagatcctaaaaatgcggatgacacatcgatttacatgttctatcaaaaagtcggcgaaacttctattgacagctggaaaaacgctggccgcgtctttaaagacagcgacaaattcgatgcaaatgattctatcctaaaagaccaaacgcaagaatggtcaggttcagccacatttacatctgacggaaaaatccgtttattctacactgatttctccggtaaacattacggcaaacaaacactgacaactgcacaggttaacgtatcagcatcagacagctctctgaacatcaacggtgtagaggattataaatcaatctttgacggtgacggcaaaacgtatcaaaatgtacagcagttcatcgatgaaggcaactacagctcaggcgacaaccatacgctgagagatcctcactacgtagaagataaaggccacaaatacttagtatttgaagcaaacactggaactgaagatggctaccaaggcgaagaatctttatttaacaaagcatactatggcaaaagcacatcattcttccgtcaagaaagtcaaaagcttctgcaaagtgataaaaagcgcactgctgaattagctaacggcgctctcggtatgattgagctaaacgatgattacacactgaaaaaagtgatgaaaccgctgattgcatctaacacagtaacagatgaaattgaacgcgcgaacgtctttaaaatgaacggcaaatggtatctgttcactgactcccgcgggtcaaaaatgacgattgacggcattacgtctaacgatatttacatgcttggctatgtttctaattctttaactggcccatacaagccgctgaacaaaactggccttgtgttaaaaatggatcttgatcctaacgatgtaacctttacttactcacacttcgctgtacctcaagcgaaaggaaacaatgtcgtgattacaagctatatgacaaacagaggattctacgcagacaaacaatcaacgtttgcgccaagcttcctgctgaacatcaaaggcaagaaaacatctgttgtcaaagacagcatccttgaacaaggacaattaacagttaacaaataaaaacgcaaaagaaaatgccgatatcctattggcattttcttttatttcttatcaacataaaggtgaatcccatatgaactatataaaagcaggcaaatggctaaccgtattcctaacctttttaggaatattgctgtttatcgacttatttccaaaagaagaacatgaccaaaaaacaaaatcaaaacagaagccggactaccgggctgcatatcattttacgacgccggataaatggaaaaatgaccctcaaaaaccgatctattttgatggcaagtatcattatttctatctatataaccgggattacccaaaaggcaacggcacagaatggcgccatgccgtctcagaggatttggtgcactggaccgatgaaggcgtggcgattccgaaatatacaaacccggacggtgacatttggaccggttccgtcgtggttgataaagagaacacagccggctttgggaaaaatgcgcttgtcgcgattgtgacacagccctcagccaaagacaaaaaacaggaacaatatttgtggtacagcacagataagggaaaatcattcaaattctacagtggcaaccccgttatgcctaatccgggtacagacgatttcagagatccgaaagtcatatgggatgaccaggataacaaatgggtcatggtcatggctgaaggatcaaaaatcggcttttatgaatccgataatcttaaggactggcattacacaagcggattcttcccagaacaggcgggaatggtggaatgtcccgacctctacatgatgcgggcaagcgacggaacgaataagtgggttctcggtgccagcgcgaatggcaaaccgtggggcaaaccaaatacgtacgcctactggaccggaagcttcgacggaaaagaattcaaagcggatcagactgaagcccaatggcttgactatggcttcgactggtatggcggtgtgacgttcgaagacagcaaaagcacagatccattagaaaagcggtatgcgcttgcctggatgaacaattgggattatgccaacaacaccccgacaatgaagaacggctttaacggcacagattctgtcatacgcgaactccggctgaaggagcaggatggaacatacagcctcgtctcacagccgattgaagctttggagcagctgactgtttcaactgacgaaatagaggatcaggatgtgaacggatcaaaaacattgtcgataacaggtgatacgtaccagcttgatacggatctttcttggtcagagctaaagaatgcaggcgtcaggctcagagaatcagaagaccaaaaacgccatattgatgtcggtattttcgctgaaggcggctatgcttatgtcaatagagcagccacaaatcagcctgacaaaagcaatacctatgtcgaaagcaaagctccttatgatgtaaacaaacgtaaggtgcatttgaaaatacttgtcgataaaacaacgatagaagtatttgttggcgacgggaaaaccgttttttcaaatgaagtcttcccaaagcctgaagataaaggaattaccctttattctgacggcggcacagcctccttcaaaaatataacagtgaaacactttgattcgattcatgaataaaaacaggggcagcgcaggctgccctgtttttttattaggagcggtattctctgttacatattgggcattgtaagaaatataaggctggtttcaaaggaggaagcgaatgtctaaacaaggaaattttcaaaaatcaatgtcgctgtttgatctgattttgattgggatgggagccatctttggatcagcgtggctgttcgctgtcagtaatgtcgcttcaaaagcagggccctccggcgctttttcctggatcctcggaggagccattattttgttaatcgggctcgtatatgcggagctcggagccgctctgccccgtaccggaggcatcattcgataccccgtttattcacatggccaccttgtcggctacttaatttcgtttgtcacgattgtcgcttatacaagcttgatttcaattgaagtgacagctgtgcgccagtatgtggcctattggtttcccggcctgaccattaaagggtctgattcgccgaccatttccggctggatcttgcagtttgccctattatgcttgtttttcctgctgaattattggagcgtcaaaaccttcgctaaggcgaatttcatcatatcgatttttaaatatattgtgccgattaccatcattattgtgctgatctttcattttcagccggagaatttatccgttcaaggatttgcaccgtttggatttacaggtattcaggctgcaatctcgacaggcggcgtcatgtttgcgtatctcggcctgcacccgattgtatctgtagcaggtgaagtccaaaatccaaaacgcaatatcccgatcgctttaatcatttgcatcatcgtttcaaccatcatttatactgttttgcaggtcacctttattggtgcaatcccgacagaaacactgaaacatggctggcccgcaattggccgggagttctcattgccgtttaaggatattgcggtcatgctcggattaggctggcttgcaacgcttgtcattttagacgccattctgtctcccggaggaaacgggaatatctttatgaatacgacatcccgccttgtttacgcctgggcgcgtaacggcacattatttggcatattctcaaaggtcaataaagatacggggacaccccgcgcatcgctttggctttcgtttgccctgtccattttctggacacttccctttccttcgtggaatgcgctcgtcaatgtctgttcagtcgcgctcattctttcatatgcgattgcacccatttcttcagctgcgctgagggtcaacgcgaaggacttaaacaggccgttttatttaaagggaatgagcattatcgggccgctttcctttatatttacagcgtttatcgtgtactggtcaggatggaaaacagtctcctggctgctcggttcacaactcgtgatgtttttgatctatctctgtttcagcaaatatacgcctaaagaagatgtcagcctcgctcagcagctgaaatcagcctggtggcttatcgggttttatattatgatgctgatcttttcctacatcggttctttcggacatggtttagggattatcagcaatcccgtcgacctcattttagtcgcgatcggctcacttgcgatttattactgggcaaagtataccgggctcccaaaagccgccattgattacgataaataaagaagcaagaggttttcttgcttctttattctttacaaacatacatacacgcgataaaatgaatgagagtcagtcattatcggaggtgttcctcatgccaaaacaaacatcgggcaaatacgaaaaaattctgcaggctgccatagaagtcatttctgaaaaaggcctcgacaaagcttctatttctgatattgtcaaaaaggccggcactgcccaaggaacattctatttgtatttttcatctaaaaatgccctcataccggccattgcagaaaatctcctcacccatacacttgatcaaatcaaaggtaggctgcatggggacgaggatttttggaccgttttagatatattaattgatgagacatttctcattacagaacgccataaggatattattgtcctctgttattccgggcttgcgatcgaccactccatggaaaaatgggagacgatctatcagccttattattcctggcttgaaaaaatcatcaacaaggccattgcaaaccacgaggtaacggaaggaatcaattcaaaatggacggccagaacgattatcaacttggtcgagaatactgcggaacgattctatatcggatttgaacaagatgaaaatgttgaagtgtataaaaaggaaattttcactttcttaaaacggagcttaggtactgcttaaaaaatgactgggtaacaccgctcattttttaatgccctaaaaatgactgacgttcattcataaaatagagaggtgtttcatttgaattgggttcttgtttttattgcagggcttttagaagttgtttgggcctcttccctcaaacatgccgattcgcttttggattggatcatcatttttatcttaatcgcggtcagctttatcctgttgatccgctcttatcaaaaaatcccgatggccgcggcgtacactgtgtttgtgggaatcggaaccgtcggaacatatctgactggaattgttctgggcgaatccttctcagcagcccaaatgttctttttagctttattgctggctggcattttaggaatgaaattatttacgaaagaaagcaaatctcagccgggaggtgaacaataatggcatggtttttattagtgattgccggcatagaagaaattatagctgccattgccatgaaatatatagacggaacaagaaaaaaatggccaatcattgtgatgactgttggattcggcttatccttttactgcctttcccaagcgatgatcgtcctgcctgccggagtcgcatatgccgtctggactggcattggaagcattggtgtttcggcggtcgggctcatctggtttaaggagcggtttcagctttcacaggtgatttcactttgccttatcctagccggcgtcatcggcctgcgtcttacgtcatcttcataaaatcaaggcatatacagctgtatatgcctttgccattaagcttcgtgatgtttttgaagatgaagcggcggtgggatgagccagcctttgttttttagcagccttaagtattttgcgccggttgccgctttcgacatatgaaattgcccaaacatcatggcaatatcctcacgaatcgattgccccatcattttgctgcatgtcaccagacctgcagcattttctgctgccgcggaggccgccacatccggatcgagaaaccgtgcgccaggcggaatgtcgttaagatctgctgtcggcggttcaggagaagccggcggcagcgccaccccgttttctttcaggatcgtgctgacctgtttgatttcatcttggcatttctcaatagactcacgaagcagtttcttcaggtcgtcatcaccgacatgattcaatagcatttggtaattgccgaccattttattgcccgccatcacataactccacaagccgaatacctcaccgtaatgcatcggttcatcctgcggatttccgcttaaaatacccatgttcatcctcctcccatattcaatattgcacatttcataacgtgcccaagcggaggaacatttatgtttcagcggaaaagatttatgaaatgaaacaaaacaaaaaagacaagagtggcaagttgccaaaccattgtctttcctgttgtttgattggacgcactgaagggattcgcaccccgacagacaagataccggaaaccattcaagtgctttttaatatgagtcattgattctgtctttaataaactttaacgagatggcgggatgctttgcggaaaacgaaatacattttcggggtcatatttcgcctttatttctcgaagccgcgcaaagtttgcgccataatattcttttccgaagttttcaatgttttgatctggaacattaacatatgaacctgctacatatggttgcatcagctgacgcactctttcaactgatgcaagatttgaatcttcttgtgatttatttttccaactagccgtccattccgtataaaatattggatggcgccaaaaaaaggcagtttcgtctttagggactctgcttatagcaccaccccaattgataaaaaagaaattggcatctgttccagtagcgtcttccaaaaattttctcatgattgaaatgggttcgtcagaccaaaaatcatgaccccaagccgaggagaatttaacactctgatcatttctgccagggatgggttcgtcagggtctaagaaatctatagcatctggatagtataatgttttgatatctgcttctgttggagttcccgcatgtaataaaggttttaataatcgaatcaattcagttttcgaaccgaggaaaattccttctgcatgacacaaaccatttattttgctgtaaatttcaaggtagcatcctaatcgttcatctacaaacggagcccatttctgccaagctttaaataccgtttctaattgttcccacggccagataatattgaagacggttgcagttttaggggcacgatgaactttgaatgtatattgggtattatatccaaagttacctcctcctccgcctctagaagcccatagcaaatcctcattgtgagattgatctgcatgaataatccttccttttgcatctaccgttttcagcgcgagaaggttatcacttataaggccaatcgatcgtgagagtacaccaaatccgccgcccatcgtaattcccccgattccaactgttgggctatctccaaacggagccataaaaccgtctcgagctaatccctttacaagcgggccaacgggaataccagtttgaacggttgcaatcgcgttttcttcatctaagaaaactttattcatgtcactcacatcaataacaattcctccacttactactgaaaggttcttatctaaagcatggcgaccgcttctgacacgtaagggcactttattctcacgagcccatttaatggcattacttacatcgtatgaattttgcgcaaaaacaaagacaagaggatagacatccacataagggttccaattcttaatagcctctgtatagccggggtctcctttgaaaattacacgccctgtcaactgtgttgatcccatatattatttcactcctaaagaaattcgattcagatactaaaatatgcaggagctggataatcgcatagacaaatgatctacgaactataaatataatacgctaaggcctttttcgtcggtaaggtctgctgagaaacatttttcaaacaattttgagcaaacttcctgtccaatcctccaacaagcgttttttcttatcgtttttaggagcagtgtccagtttttttcggagtgaatattcgtttaggccaaaagaaaagagagatgaagaagtgtttagtaccagaggtatacatccatacaacagactctagatcatcatatactgaatgtatgtagaaaggagacatcagctttggcaaaatatcggattatgacctttgacggcggcggtaccttaggtgctttaagtttgcaactgttaaacagattggctaggcaaaacccgaagttaattagtcgaacccatgtattttcgggaaattcaatcggttcatttactgcccttgcattagcaagcggaagatctccgagggaaacacttcagtattttgaggatgaaatcctacccgcattcagcatttcccggccaggcggacctgttttcaaccaacaattaccctattccggttttattaaagcggtaagaaattttttcccagcagatcttcaacttatagatttaagaaaacgaattgttgtcccatcattcaaattatactctcaaaaactggatcgttggactcctgtcttatttcacaattttcccggctctccctatttaaatgagaaagtaagtgatgtcatactgcggagcagcggtgctcccgcgacgcaacgggcctatcaaaactatgtggatgggtatgtagtagcaacgaaccctagtacagccagtatcgcgtttgcagttggtaaagccaatgtgccattggatcaaattgcggtattgtccatcggaacaggtgaagccccgacccggttaagaagagatacgaagggatggggaatggtaagtgcagataacatccgccccgaaaatctgaagaaccttcctccaaattggggagttcttttggacaggtcgcctaatgaacctttactgccatttcttcagatgattgctggcggtaatgggtactatgaatccatggtcagtgcgaatcttctgggagatcgttttttccggttagatccacggattccgaacttctccaaaacggaccctgccgtcgttcccgctgtcattgaaattgcgaacaaaaccaacttacagcctgcgattcaatttatagagaagaactgggggagtaaataaatttttattttaaaactattctcacttatccaattttgtccgagagaagattctcaaaataaatacaggcaatgggtagaaccggatttttttaaaggtttgttaatcacaagctaataagatgaatgaaaaaatcaattcatacttcttcttttgaaagtgagggttcaaactaaagaatgtaattgaaatgttactctaaggtatgcaattccctttttcacacaaaaaagacaagagcggcaaatcgccaaacccttgtctttcctgttgttctattggacgcgctcggagggattcgaacccccgacagacgtggtaccggaaaccaccgctctatccaactgagctacgagcgcagaatgactgcgttatgagaacgtcagcacaactaattatacgataattccattcaaataacaaccctctatttcgagaggccgttttttaaatagacaaagcatcttaattggcaatctgacatacgatggtttgaacccctgtatttttggggaaaatgggaaaaagagacgactttgcatatcaggccagctttttgtttgacctttattgaccaaaaatgtatcatgtaactacatacttacctaaaaggtgaaggaggagcattatgaatttaatacctacagtcattgaacaaacgaaccgcggggaaagagcgtatgacatttattctcgtctattaaaggatcgtatcatcatgcttggatctgcgattgatgacaacgttgcgaactccatcgtgtcacagcttttattcttagcagcagaagaccctgaaaaagaaatttctctttacatcaacagcccgggcggctctattacagccggtatggcgatctatgataccatgcagtttattaagccgaaggtatctacaatttgtatcggtatggctgcgtcaatgggcgcgttcctgcttgcagccggcgaaaaaggcaaacgctatgcgcttccaaacagtgaagtcatgattcaccagcctcttggcggtgcgcaaggtcaggcgacagaaattgaaattgccgcgaaacgcattctcttgcttcgcgacaaattaaacaaagtccttgctgaacgtactggccagccgcttgaagtgatcgaacgcgacacagaccgtgataacttcaagtctgctgaagaagcgcttgaatacggcctgattgacaaaattttgactcacacagaagacaaaaagtaataacacaacctgcaagagctgcgtctcttgcaggtttttttcatttcaaggaattgactcccttaaacactttttgttctatactgctcccatccctcatgtaacagctcaagcgtcaaatcattcgtctgcctcacaaccagatcagcaccaagcatcggctgtccttgaccgacaccaaccgcaaacatccccgcagatttgattgcagaaatgcctgcttctgcgtcttctattgccgcgcaatcagcaggggaaacatcgagcatcgctgcagctgttaaaaagatgtcaggatcaggcttccccttcgcaagagtcgtcggatcaacaatggcatcaaaatcatcgataattgccaaacgtcttaaaatcttaggagcattgcgacttgaagatgctaacccgatttttatattttcgtttttcaattgacatagaagcctgccaatccccggtaaaagatcttccggcgtcaatttgctgatcagcatttgataatcgcgatttttccgatgcataagctcttgtttctccgcatttgtatactttgtttccgcaccgccaaagatcaatatgctttcaagtgactcttctctgctgattccttttagcctttcattcatgtctctgtcaaaagggatattaatttgttctgcgatgtgcttccaagcgagaaaatgatattcagcagtatctgttatcactccgtctaaatcaaaaatgaccgctttcatatactaatgcccatcacagcttcataaggtttgaggctaatactctttaagtccgcccgctcctgcggatagtttgaaatcagcactttccaacgctcatgaatcagttctggaggcgcttcgaacagagccttttcttccgataaattcacaacgacaagaagcttttccccttgatattctcgaaggtaagaaaagacctgcggatcattctcctgcaaaagctgataatcgccatatatcataatcttatattgctttcgtaattgaatgagcttctgatagtaaaagaaaatcgaatcttgatctttcaaggactctttcacattgatatcttggtagcgggaatttaccggtatccacgggtttccggttgtgaatcccgcatgttttccggcatcccactgcataggtgttctcgcatgatcccttccttttatcatcacggctttgagaaactctttttctgacatcgttttgttttcgacgactagttcacgatatgcattctttatttcaagatcatcatacatctccagcggcatatcgctgttgaccatgccgatttcttctccctggtaaataaacggcgttcctttcatgccgtgcagaaccgttgcaaatgccttcgcacattctttacgcagcttcccatcattgccccagcgggaaataaccctcggctggtcatggttctcaaaatacagggtattccagccgacattcattaacccggtctgccaccttgtcatcgtcttttttaaagcaatcaaatcaaacggcttgatctgccatttcccatttggcgagttttgttctgtatcaatatccatatgttcaaatgtaaagatcatattcagctcttgcctgcttgcatctgtgtactttttcgcctcttcaatatcagagccgtttgcctctccgactgtcatgcagtcgtaatgagaaagcacttccctgttcatctcttgaataaactcatgaagacgggggccgttagagtgataacggccgacaatatagctgcggctgtgatccgtttcgtagtccggaaaatcggtgtatttagaaatagagccgatcacatccatccgccagccgtcaacgcctctatccatccagaatctcattacatcataaacttcccggcgaacggcttcgttttcccaatttaaatcaggctgttttttcgaaaagtagtgcaaataatactgctctgttccttcatcgtatgtccacgctgagcctgaaaagatcgatccccaattattcggctctgagccgtccggtttaggatctttccaaaaataataatcccggtaaggattgtccttcgacttgcggctttcagcaaaccaagcatgctcatctgatgtgtggttcacgaccaaatccatgacgattttcattccgcgtttatgggcttcatcaatcagctgaaacatatcttcatttgtcccaaacttttcgtacatgtttttgtaatcgctgatatcatatccgttgtcatcctgcggggaatcaaataccggggagagccagatgacatccgccccgagatttttgatgtaatccagcttttgaatcacaccttgcaaatccccgaatccatctccattggcatcataaaaactgcgcgggtaaatttgataaacgacagcttctttccaccattcactcattaggcgttctcctttcacatcgtccctgtaggacaactggttcctcataaacgttcatgtgcagcggctcgccttttacaagctcaaaaataacgcgcttttcgtcaaccgtcacattgattaatcgatttcgataattgatgttgaatgaatattcgtcccattctttcggcaaaaacggagcaaatgacagcgtctcattcgcggtgcgcatgcctgcaaagccatgaacgattgccagccagctacccgtcattgaagtaatatgcaagccttcttccgtatcatgattgtaattatcaagatcaagccttgctgtgcgcttatataattcgagcgctttcttttccagcttgagttcggctgcgagaatcgcatggacagagggcgataggcttgattcatgaacagtcatcggctcataaaattcaaagtttcgccgtttttcttccattgtaaaacggtcattaaaaagataaatgccttggagaacatctgcctgcttaataaaattggagcggagaatcttgtcccatgaccaattctggtaaagaggccgttccgctggatctaattcgtcaactgcttgcaggtctttatccaagaacgtgtcatgctgaacgaaaatttgcagttcttcactatacggatagtacatgtgctggatgatttctctccagactttcaattcttcttcctgtacatccagaaggcggcgtttctccgctgagatactttcgagactttgtagagtatactccaacgtccaagccgcaatgacattcgtataccaattgttgttaacgttgttttcgtattcattcggccctgtgacgccatggatcatatacttattttttcgtttcgagaagtgaacacggtcggcccaaaatctgctgactgccacaagtacgtctatcccgtattcttccatatagttacggtcgcctgtataattgatataattgtagatcgcataacagatcgcgccattgcggtgaatttcttcaaaggtgatttcccattcgttgtggcattcatcaccggtgaacgtcaccatcggataaagtgcccccttcatccccaattttgccgcgtttcgttcggcagcctccaactgatgatagcgatacaaaagcaggtttttcgtcacctccggctcggctgtcgccaaatacatcggaacggcgtacgcctcagtatcccaatatgcggcacctccatatttctcgccagtaaatcctttcggcccgatattcaaacgggcatcgcccccgtaatatgtcgagaataactgaaagatattgtagcggattccttgttgaagctcctcatctcctttaatctcaatgtccgcttttgcccatctttccttccatcgatcagtgtgcctccgttttgcatcttcatagccgttctctaccacatccgccaaaagctccttggctttcgataaaagctcttcctcccgaaaatcacgggaagtcgtgacaatcacaaactttttcaatgatgccttcgtttggtagctgtagcgattctcgacatacatttcattcgttttaaagcttttattgacaaaaccctccgtctcatttgccattgcggctaaaaccgtgaagcgcggtgttccaaatggattttcgatcgtttttgccgctaaatggccgctgtgagaatcagcacctttcgcttcctcctgccaaaactgttcttggtagttagaatcttcatttgccacatttccatccaggtaaggaacaagcgtaatgacagcatctcccgtcaggcactccgcttcataatgaatcgcacagagttcttttacagcaaggctaagaaaccgctctgacctgattctgacggatttatcctgaatgcggacaacagcgcttcgccgcagaatcccctctttcatattgagttctacctcaaatgattcgattgggttttgatggagatcgattttttcaccgtcaacatataggcctatgcccataaagttcatcgcattgatcacttttccgaaatattctggatacccgtttttccaccagcctactcgcgttttgtcggggaaccacacgcctgcaatatatgtgccttggtgactgtcgcctgaatagccttcttcaaaattccctctgacccccatatagccattggcaagagacgtcaggctttccagcagccgtgtatgctccttattaaatgtatttgttttgattttccattcatcaatctcaaataaccgctgatttatcatcatttcctcccgaatgtaagtttccattatcacggcgggttttggtcaaatatctaaatgcaaaagaaatcatcaaagtaacgccacacgaatggatcatcaatacagtaatcaaatcaaaatgaaccatgccgatagcagctgccgcaaatgccggcagtgccgaggcgcaaatcgccgtagatactgcttccttgaatgacgcaatagagatcatgtttgatatttttgtgatccagaggccacctgcaagaacaaacgttaacaaaagctggatcataaagattaccgcatatgccagcatcatgatcatcggcttatactgtgccaaccataatgtatcgatcaaaacctctacatcatggacgtttggtttctcgagcttaacgtccattttcgcatagccaacagaaaaccccgtttcgttttgatcggtgatcaccagttgatcaggttgaaatatgatagcgttttcaaatccagttactttcaatcgcccattttcaccgcttgtctcatattcatgcttcatatcgactgccatcacattctgcccatcttcaatcctctcagaactcttcccgcctgttagttttccgttcctgatttgaaaaccctgtaattgatcagcaaattgatcattaaccccttgaatcgctgacggcatgaaagatgcaacgctgaagcgatccattttcacaaacgaaaccgctaacggcgtcattaagcaggccgttaaaaacagaaagagaaaagagagctgcagccagctgaaagtattcccgtaacggcaaacacctgatggggatgcacccgccttcaggcagcggatgataaagcttttattctccagattcttcattggcattacccctttgttccgccggctgtcaatccggacacaaagttcttttggagaaaaaagaataagacgcatatcggcagcgcggcaagtatggcaccggctgcaaatagagctactttttgctgctgcggattagaaataaaggattgtaatcctacagcgatggtcagcctttccggtgagcgaagcagaaatttcgccagcaaatagtcgccaaacggtgccataaacgcccaaagcgcttgtaccgcgagcattggcttaacaagcggcagaacaattgaagcgaaaatcctcagatgtcccgctccgtcaattcgcgcggcttcatcaatttctctcggcacagtatcaaaataacctttcatcagccacgtgttcatcggaattccgccgccgatatagatcgctgttaaaaaccagtattgatcgagtgcgcctattagcatcgccaagacataaaaagcagtcagcgccgccattgtcggcaccatttgaatgattaaaaagaatatcaggctcttttttctgcctgcaaaccgatagcggctgtacgagtacccggcaagtgtcacaatcgtaacctgcaaaaccatgaccgatagcgcgatgacaagtgtattgctgtaccaatgaagataaagcgtttcttcaaatagccgcttaaaatgatccaacgtccaaggacccgaaaaatcgagctgaaaagccgccgaattccccacacggaaggctgatgatgccgtaatcagcaacggatatataatgacaatacttaaaagcgtcaaaaagaaatacgtacagattttattaagcattctggcagtgctcgcgttcacctacataacctcctcattgccaaaagcattcgattttttgaaagcaatcagtgaaattccaatgacaatgaaagaaattaacagtgtcacagccgccgcaacggaatattggggtgatgtgcctgttgtcagtttataaatccacgaaattaagatatcggtcgatccggccccggctcccacactgcctggccctccctcattaaataaatagatgatcgagaaattattgaaattaaacgtatactgagtaatcatcacgggtgctgtggcaaataaaatcatcgggaatgtaatatgccgaaaacgctgaataaaagtggccccgtcaatctttgccgcttcatacaattcacctggaatcgcctgaagcactcccgttaccatgacataaatatatggaaagccgagccacgtctgaatcataatgagggctgtctttgtccagaaaggatcagtcttccacgcgatcgcaggcagctcaacaaacggcaggtgattgaatagtggaatcacctgtgcattcaccgctcctatgctgtcgttaaacatgttggaaaaactcatgattgtaataaacgccggaacagcccatggaaataagaaaatcattcgaaatatccgcttgccttttataaaatcctgattgacgaaaagggccgtcacaatacctaaaatgatttgcagcgttgttgcacagattgtccagataaccgtccagcccagtacattcacaaatgtttcacgataggagccaaggaaaaaaatattcaagaaatttttaaacccgacccagtcaatcagacgattaggcggaatatgataaaaatcatagtttgtacatgcaacaaacagagtcaccaaaaccggaaagataatcacaaacaccatcatgatatatgccggcagtgtaaatagatatggaaaccctttatcgcccgcatgacagatcatatccttggctattgtattgacttccaaacccgccgctttcatagcggcggtcttacgtgaatcatgaatattaaagatatagaacatgaggaaaatcattgtcacgatcaattgcagcgtgccttcaatcagcataaacagcgagtggtcttcaccgggaacacttcccaatgtcatcaatccggttagcgcctgtataccgaaaacgcataattcaaaagcaaacaagcctgtaatggcaagaaataagagcccctttgacaattgctgattcgcaatctgcccaagtcctggaatgatcgataaaagccctgcctttcgtttttgctttgcaagtgtgtgatgtttattcattttttccgccctctattcttccggacgctatcccgccgttttatttcacatacttttctttaatattttcctttatgacgtttacagcatcattcgctgatgtttgtgtcgatttttttcctgaagctgcatcaaaaattaaactttccgctcctgtccatacttcagccatttccggaatatttggagtcggcgtcgctgtttcatattgtttaatcacagctgacgtcagttcattcttttgctcatcggctttcctccttgcggcagtgttggccggaacttcgtttgtattctgataaaaagcgtaagcattggcatcatttgcagcatactcaagccatttttcagccagctcgggctcttttgtatattttgaagctacccagcccttcccgcccgcaaaaggggcatattcttctccattgggcaatgtcggaatgggagccgctccgtagttcaatttagcctctttatagttggcagctgaccaaggaccgccaatgatcgcagccgctttgccttctaaaaacatctgctgaataaagtcgtctgcgcttgaattgtcttgcattcctttcggccaatatgtttcaaaccatttctccgcatatttcaccgcttctacagcccctttattgttcaggccgatgtccccggaatctgtgccgttttttccaaacacatatccgccgtaaccagccaataagccgtacgacatataaaagtcagtccattttgctaaaaatccggttgattttcctttttccgaagcaaacgcgaatcgaggatcttccgttaacttttcaaggtctttaaatgtttttggcgctgtttttaaaagatctttgttgtaatacaaaataagtgtctcaatgactagcggcattccgtacactttgccgtcaactgtcacctgctgcatttctttatcaccaaagctttttgtgttagatggcttaatatcaagtaaatgtccttgttgtcccaaaccgccgatccggtcatatgcagcaagcataacatcaggcgcattacccgccgggccatcaagaggaagcgcttctaactgttcgaacatttgcttttcaacaatttttactgtgacatcattctctttttcgaactttgtttttatgctttcaatgtattctttatacgtttcttcgacggacacagtcagcacctttttgccatcagcgcttgctggattttttgaacttgagcaggcggcaaggccgattgccaggaatgatgccgccaatatggcgaaccccttttttaaaagaaccatctcttttcccccttctatttacgaaactataacaattgtattgtcctatagaaagcggttacaacaacttttgatttgttaccgataacagaatgttatacaggggcggcagcactcaaaatcaaaaattctcccggctgaacggtaatgacatcgtgatgctgaagcggctgctctgtccatgcatcacagatcctcttattcctttcaatattcaaatccagtaaactgacatgttgaaccgcattcccttgattaaagaaataaatcagtattttttcatcaagagtccgtgaaaagctaataaaatcgttttggtcatccagcagattccactcaagatgtccttcagtcaataaagtgttttcctgcttgcgtaaagcaattaaccgtttcataaattgcagcatgtcttggttttgcttctctttttcccaaaccatacattttcggcataatggatcattttcgccgttcagcccgatttccgttccgtaataaatgcatggtgagcctgtctgggcaaacataaaggccagcaacgcgcgtgctttcttctcatcattgcggcatctggtcaaaaggcgctttgtatcatggctatccagtaaattaaacatcacctcattggcctgcttcattccattcatcaaatgtgcattgacacggtgagccatacgtgaagctgagatcgtctggtcagcaaagtattcaatcataggctctgtaaaagggtaattcatcgccgcatgaaattcatcccctctaagccagggttcggcagaatgccagatctcacctaaaatataaacatcaggcttttcagtagatacagcctgcctaaatgtcttccaaaaagcgtgatccacttcatttgcgacatccaaacgccagccgtcaatgtcaaattcgcgaatccagtacaaagcaatatcaagcaaatatttctgcacctcgggattagccgtgtttagcttcggcatatcagctgtaaaagcaaacctgtcataattgtcgtctgtgacgggaaaagagtgaatatggaaccagtctttatagcgggattgatctccgtttttgacgacatcctgccattgcggagacgcgcttcctatatggttaaaaaccgcatcaagcataattctcatcccccgctgatgcagctggctgaccaatgtacgaaaaagctcaggatccccgaaatgcggatcaatagaaaagtaatccagcgtgtcgtatttatgattagaaggcgcggaaaagatcggtgtcagataaatgccgttcacccctaaatcctctaaataatcaagcttgtcaacaattccttgtaaatcccctccaaaaaaatcattgacgcccgggtccttgctcccccacggcaatgcattcttcggtgacaagtcttctcttccatttgcaaaacgctccggaaaaatttgataccaaaccgttgacttgacccattcaggcgcttgaaatgtatcagcctcgtgaacaaacggaaatttaaagtaataatgaatcgtttccagtgttttttcgttataagggcatacacccgaacttccgaaaaagatgtcttcatgatcgtctgttacaacaaacgcatattgtaaacgcctaaatggcggcaccacttcagcaaaccaatagtcatgcatttctgtagcagcaattttcctcatcggctgctcgtttgccgaccacttgccgtcgttgtactcatagggatcaccccaaatgaatcgaatgtgatctgcatcacctttttttgtccgaatcttgatatgcacagcccgcccatcataagaataagcatctgtgctgaatggctggtggtgaatcgctgcatattccatcatgtttccccctttgatttccgttttattgaagccggctcatagtttgaaagtatcatgatgaaattgtgggaacaatccttttcaccctgttaccgataacagaataaggcgcttacagcgttgattctcgtacaattaactctggttcaaaaaatagacttccttgtgcagcaccgtcttcattcatttttttcagcaacattttcgcacaggcttcccccatttcaacaacaggctgtctgaccgtagtcaagcgcggcgaggagatgcgatcaagaaacacaccgtcattcccggtaaccgcaacgtcttccggaattctctttccaagggattgcgccgcacgaatgacgccgagcgcgattcgatcagatgcgcagacaaatgcggcttgattgtccatggatttcagcagttctcttgcaaggccctcacttttcttagaactgttgtcgatccgaaacatattcgattttttaaagcttttattcatcgcccgtatatacccctgttctcttgcacgttcgaaaggctcatctaaatcaatgccaaaaaagacaacttcccgctcccccagccccataacatggcgggttgccataaaagtgcctttctcgttattcacatcgataaagtcatagcccatttcattttgtccaaatacgacgagcggcttctcaaacgcttttattacaccttcaaaatcgttctttctcaagccggtggcaataatgccgtcacattggccaatattaagagaatttcttgtcacaagctggagagcatagtgattgcgatccagctccctgctgattcctgtcagcaggttcatgtaatatggttctgtcgtatccatttcctcaagtatcaatagtttcacaacctgtgttctgttttgcacgagcgctctcgccgcataattagggatgtaattcagctctttcatcgcagaatgaacaagctttttcaattcatctgtcaccgtctcagggtgattgatcactcgtgataccgtcattttcgaaacatttgctttttttgccacatctgacaatgttgccattttcatcccctccttatctgtgcttattatccaaactagtgataaagtcctctattactgttaaatatacgatgcaggcaaaagagaaataaaaaagagatttcccttaaggaaacctcactttgttaaaaactctcgatttttcatggattcatacgctaggtggcagactcattctctccacttccatgagaaagtctcttttttaaatttctgtccactttttttctaaaatcggataagaataattttgcatttgctcaattaactcatccggccgtgacgagctgtgaatcagttttaggtgcgattcgttagaaaacccttcttgaatgctgtatttcaccattttcatcattggttcaaaatatccgtttacattgtacagtccgattggcttttggtggatgccgatctgtgcccagcacagcacttcaaataattcttcatatgtaccaaagccgcccggcatcgagataaagccgtccgccagctcgctcattttagcctttcgttcatgcatcccgtttacttcaatcagctcagtcagattctgatggacaacctccccgctgaacaaaccgctcggcatgaccccgattgcagttccgccgttttccataatcgcgtcggcaatcgtgcccatcaagccgacgcgggagcccccatagacaaggccgattccctgctcagccatatacacgccaagctctgccgcttttcttttatacgcttcatttcccccagggtttgatcccgcaaatacacaaatggttttcatcttgtcatctccgcatctatatatcgtgttaaacattcaaaaacacactatatattgtcccatcttcatgtgataatatcaatatgaaatacataaagaatgcaggagtgatgaggttgcagctggctgatgcagaaaaatggatgaaagagttttacgaaaaaagaggctggacagaatacggaccttttattcgcgtcggctttttaatggaggaagccggagaattggcccgggctgtcagggcgtatgaaatcggcagagaccggccggatgagaaagaatcgtcacgcgctgagcaaaaacaagaattgattgaagaaatgggagatgtcatcggaaatatcgccattcttgctgatatgtatggtgtctctttagaagacgtcatgaaggcccaccaagaaaaactgacaaaacgatttgagcatgcataaaaaagcggccgcgatggccgctttttttaacctgtgatttcatcatggtgatcaaagaaatgctgctttcctattttgtgaaaaaggcctgttttatgcagcagctcctttggctgcgattgcaatcctacaatcatcagctttccattgtggcgtttaatccgattcataatgttcccaagcaccgcttcagctgacgtatccatatagtgcaccttattcatgagcagaatgagggttttcggttttttctgtacatgctccagcaatgacgattcaagggaatcaattgatccgaaaaacaacggtccttctatggcatacatgctgacagatggatcttctctcttcgccagaacaggatgcgattcctgattgtggatgcgggtcgcttcgctcattcttctgataaagaacacaaatgcaagcagcaatccggttgccacaccgatgattaagtcaaacagaaccgtaagggcgaaggtcgccgccaaaataaaggaatcagcgtttttcagtctcagcatgtttgcgacttccttgcgctcactcatattccatgcgaccaccatgagaatcggtgccatactggcgagcggcacatgggacgcataaggcgcaaatacaagcaggacaaggagaacgactacgccgtgaacgacgccggaaactggggaaaccgctccgttttttatattggtcgccgttctcgcaatcgctcctgtagccgggattccgccaaacaggggcgctgccatattcgcaattccctggccgacaagctccttattgctgtcatgctttgagcccttcatgttatcagcgaccattgcggacaaaatcgactcaagtcctccaagaagcgcgatgacaagcgcagccggaaacagcataaccattttatccaaagtaagctcaggaaactgaaattcaggcaaatggcgggggatttctccataagttgacccaatcgttgccatgcggtcagggaaaaagacaaccgcgaccactgtggaaataagaagcgccaacaaagcgcccggcactttaggcatcaccttggcggatacaagcaaaatgacgagcccgatcacagctgtcaaaatggcatatacgttaaaggtgccgagctgctgtacaatttcaaacatgttgtggtgaaagttctcatgtttttcaacatttctcaatccgagaaaattagcgatttgttccgtaaagatcagcacggcaattccggctgtaaaaccgacgataacgggtttaggcacgaatttcattatttttccgagcttaaacagcccaaacagcaccagcattacccctgccataaaccctgcgatcagcagattctctaatccgtactgcatgataatgccgaacagtatcgggacaaaggcgcctgtcggaccgccaatttgatatttagatcccccgaacaaagagatacaaatccccgctataacaacagtgtacagcccgtattcgggctcgactcccgaggcaatggcaaacgccattcctaaaggaattgccacgacacctactacgatacctgcaattaagtctttctgaaatttctgtaaattgtatcccttgaatctccctgagaatcgcatattttgttataacctcccttatgagtgattgtttattagctcagtttcataaccgttaatgaccacatcaagttttcctgtttcagggtgaatgacaagcccgtgaaccggcacttttttcggaagcagcggatggttcttaatcatgttcacactgtgggaaacgctttcttccacgctgtgaaaaccagtcagccacgttttcaaatcgagtccggcactcgtcagcaaattcaggcagctatcctccaccccgcgttcctttgctttctcaagaatcgaggacgcattcagccctgacattccgcattcatgatggccgacaatgcatacctcttcagcctgcaattcataaatcgcgaccagtatgcttcgcatcacgcttccaaatgggtgagaaacgatggctcccgcgttttttacaattttagcatcaccgtttttaagccccattgcttgcggaagaagttctgtaagccttgtatccatacaggtgacaatgacgagctttttcgaaggaaactttgtcgttttgtacggttcatacttcttctcactgacaaaccgctgattgtgttccaaaattgatgttaaagaaaccatttgattcatctcccatccatatgattttgcaagccttcttacccagcttacagtaaggaattatagcataggaataagccaagaaaaggctttcaaaaaaagacactataattggactgtagaatcaaaacataaacatttatatctttcaaagataataaaatttatatttaatgaatcctataatccggctgcagctcgcatattgatgatttgtctgacaaaaaatatgggtgaattctgataattaaaaaacttttttaagcagatatagctgttcgatcttcattttaagttcaaaagaaccagaaactaaaaaaacgcagctatatttttaacacctatttattttcgatataatgaaatagacaacagccataaagggggagccttgttgaaaccatttgtatttatcacaaaaccgattcctgaagagattgaagcattcatcggtgaacattgccgttatgaagtatggcaggaggatacgcttccgagtgacgtgctatttgaaaaattaaaagaagcggagggacttttaacatcagggacgtccgggccgtcaatcaatcgtgagttgctggaacacgcgcctaagctcaaagtggtcagcaaccaatcagtaggctacgataacttcgatatagaagcaatgaaagaaagaggagtcgtcgggactcatacaccttatacactggatgacacagttgcagatctggctttttcactgattctgtcttccgccagacgtgttgccgaactggaccgttttgtcagagcaggaaaatggggaaccgtggaagaggaagcgcttttcggaattgatgttcatcatcaaacgttaggcattatcggcatgggcagaattggagaacaagcagcgagacgcgccaaatttggttttgatatggaagtgctttatcataaccgacatcgcaaacaagaaacagaagacagcatcggcgttaagtatgcagagcttgatacattgctggagcaatctgattttattcttctcattacgccgctgactgatgaaacctatcacatgataggagaacgcgaatttaagttgatgaaggattcagcaattttcgtcaatatttcccggggaaagacagttgatgaaaaagcactgattcgcgctcttcaggaaggctggatcaggggagccggcttagatgtatacgaaaaagagcctgtcacccaagataatccgctcctgcagctggataatgtcacgctgcttcctcatatcggttcagcaacagctaaagtgcgcttcaacatgtgcaaacaggccgccgaaaatatgctcgcagcgatccaagggcaaacaccgaaaaatcttacaagagaatttcaataaatcaaaaatccggtctgataacagaccggatttcatattacatacgctgaagaacagcacgcttataaatatgacgggtgacgatataataaagagcctggaatacaaaataaatgaagatgacaattacggcctcaagaaataaattggaattcagcatattacttaacgctgcatacgcaaagcccgcgtgaatcgtacctgcgataaatgggatgaagaataaaaatcctatttgctttccaaggatcgagtgaatctctttgtccgtaacccctatcctctttaacgctaacacctgcactctcgtatcttctatttccgtaaacatccgcaaatacagcatgcttccttgcacgataaaaaacagcacgctgacaaacagaccaataaacagcattaatgcaactccctgcttcacaatttgataactaggagcacgtgtttgaaaatcagatgtatgttctttcggcaccatgttttcaagcttttcagagacatccaccgtctcctgccaatgctcaagctcataacctaccattctcatctgttccttcagcggcacatcctgtgacagactgtcaaagctcttttcgctgacaaccaataaacggctgactccatcgacagacatcaatatccctttgttttgctgctttttcatgacataggaaagggtttttcctgacttcatatgaaatgctgctgtttccccttctccaaatgtgtctttcaccatcatttgaaaagaaacattaataaatgcttcattttcttgtaaatgaataactgggaaccctttttcctttgcgacttgattatagactttttctgaaatcagcaaagcttcagcttccatcttcttatttccatacggcaagtctgactgaaaagtgacaggaatccctgtggcatccaccttatacttgataacagcatgagcttttttcaatgtattctcagctgtctcaggcttcatgacctgaaagcgggaagcatccttttccacccaggaaacagactgaggaatgctttgctcctcctgcctttgtaaatcggaataaaacatatagatgacacctgtagctgttagtatgaccgctgtaatgacagaggttaaaaacagcatgcgtgcatgatccttcagcctgaatatcatgttggaacgcacaatgatattcgtgcctttgtagaagctgtgtttctttcggtacagcatgcggaaaaacgccacactgctttgtgtaaaaaagaaatacgtgccaactaacactaaaatcaaaattggaaatacccgaaacatcatgtcaatggcattggctgttgcagatagataataaccgctgccaagacatagcaaagacaatacagtgagccatttcgaataaaccggcaaacttttcggctttttggccgatttaatcagttcaatgatttccagcttccgaatccgtcccagtgataaaatgagcagcgtctgaaacaggatgagaaagccggcaattgtcatcacaaacgctttcggcacaatggcaaacgaaatcggcaccttcacgctgagcatccatgtcataatcataaaaaacagttttgaaaataacaggcctgctccaatgccggccgcaatcgccgcaagagaaataagtgactgctcataataaatcatcttgcgaagctgctgctttgatgtgccaaacagtgtcagcagcccaaactctttctttcttgcctgcaaaaacgctgaattggaatatgtgatgaaaaatatacaaaacacaatgatgacgacaagagctgcgctcaagcatgttttgacaaggcttccgccatatatattgtcttcattgacatcaggatgaaaaataaatgatgtgaagacaaaaaacaccgaaacggcaaacacacagcttaaaaagtaggccacataccgttgcagattcccaagaatgtttttacgggcgatagttctcaaattcatgaaaatcgcctcccaacacactcaaggtatccaatatactttgataaaacacctgcctgtttgttcctctgtgaatctctgaaaagaaacgtccgtctttaataaaaacaattcgtttacagaaacttgctgctgtggcatcatgcgtaaccaacagaatcgtcgcttccttttcctcattcagctgagccagtgtgttcatcacttgctttgccgattttgagtcgaggtttcctgtcggttcatcggcaaggatgagcgccggattgtgaataatcgctctggcacaggctgcccgctgctgctgtccgcccgaaacctcatatgtgcgatgatcgagaatgtgcttgatttgcagcgtatccgccagttcatccaatcgggcttccatttctctcagctttaccttatccaatgcgagcggcaagagaatattttcacgaatcgtcagcgtatcaagcagattaaaatcctgaaagacgaagccgagttctcttctgcgaaacaaagccagctcttggtcctttaacgttttcggctgaatgccgttgatcatcatctcgccctgggtcggcttatcaatggtagccagcaaattcaaaagcgtggtttttccgcttcccgacggccccataatcccgacaaattccccttttgacacactgagatcaaaggcgctgagcgcttggtatgatattgttcctttatttgaatagtacgttttcgataggttcgttgtttgcaacacgttcatgttctgctcctcctttttctttattataaaaaggaagtcagcatcctcccatcgaactttcttgcaattccgctccccaaccttacaatgctgtcacattcacgagggtgtcacttgaaaacacgatggtcatcacagtgccagccccttcttttgattccgcatacagcttatggccgagacggctgcacacctgttttgctaaataaaggcccattccagttgcctctttcatggttcgtccgttttctccggtaaaaaacgcgtcaaaaatccgcggcagatcctgtggcggtatgccgattccttcgtcggcaaccgacaatcgcgtctcatgtccctgtgtttcaatccggattgtaatagggtctcccacaccttgctttgaatattttaaggcgttgaaaaggatttgctcgacaacaaaggaaagccacttttgatcactggaaatctgaacggcatttggcggcacatgtaatgttggaaaaaggcgccgtttaataaactgacgtttttcctgattgatcagtgaacgaaccatttctgccaaatcaaaggtttgcggctttacatcaaatgcaaattcctccagccgagccgtttgcagcatcatatcaagaccgtaacgaaatctctcattctcatcctccagctcctctaagaacgtcggaaaagaggatgaggttccgttttttccttcctgaatcattaaggatatgacggataccggtgttttcatatggtggacccattggttggtgaaggtgtaatgctgtttttgctgattgatatattgtgagagcctgctttcgtattgctgcccgagtgcgttgatcatcttcgtccaaagcacttgctctcctgttcttggctttctggctttcaaagactgtccgatgtcattcgaagaagaggcttgttctgcaagctttttaacatatgtgagaaaggaaatttgccgaacataatcaacagcaaaacctgcggctaaaagagtaccgggcaaaatccatatgtacatcatattttctttggaaggttctgcgccgctctctacaatgcttaaatacgcaatcagcatggcggaccctatccctaataatgaaaatagaataatggctaagcggtcgatgagataagtctttaacactccgcttcatccttccgattgacttgaaattgatagccttgtcctctgattgtggaaatgcaatctgtcagtcctgcattctccagttttctccgcagccggttgacattgaccgttaacgtattgtcatcgacaaaatcaacgtcatcccataacgcctccaatagttcatcacgagagacaatttttttatgctccctcacaaaaatagagagaagctgaaattctttttgggaaaacagaatacggacgctgttccattcggcctcattttgatcaggataaatcgtcagcccgccaagctccactattctagattcctgcggcaaagagggcgagtattcaccatatgtgcggcgcaggacgcttttgattttggccatcactacctctaaatggaacggttttgtgatataatcatcgccgccattttcaatcgccattacctgattcagctcatcggtccgtgccgatataaagataatcggcgcattggaaatggtacggatttgcctgcaccaataaaacccgtcaaaaaaaggcaggttgatatcaagcagcacaagatcaggcttcatttctgcaaattccaattttatatcattcagctgttcagcaattttcacttcatatccgtatttttgaagatgaccgcccagcaaagaagcaatccgctcatcatcttccacaagcaaaatccgatacacgttgatcccccttatatgtacatcacgatgatttttctagaagattccaaaattattatagcatgtgcggaatagtaaatcggtctttttctttttgttatgatagaatgataaaggtaaaattttcataataggcaggtgtcgtgatgaagaaaatcatgctgtttctggcaatgacgtcaattctttcagcatgtcagcccaactataccgggaaatacatagaaattggggatacactaactgactataccaaagagtgttttaaagagaatgaaattccttataaatacgaaaagggaaaactgtatatcccagaagatgcatttgatacagcgatctacacttgttcataagaaaaagcttgcagataacctgcaagcttttcacgttacaaaaaatgagtatttaatttctcttcaaatcctgaagggccgatgtcgcttttttgaatgtcaccgccgttttcatgaatcgtaaaatggcgctctgacatgaccatccttccgctcggcgtcagctttgaggcaagcagggatttgttaaaaggagatttttcatgagagtgaatgatgtccttcatgttatctaaatcaccgagatcactctcttcaagagtaaaggcgtacccgatttgccagccttctcccttgtccatcagcagaacatggctgcccttttctgtctcttctcttttgattcggaatgacccgactggtgactgtaccgtttctccggaaagcggtatcggctggagcgccaggttgatgccgaaaccgatatcaacgaggtaatcgccgttttccgcagacagccatacagcagcatgcgtcccttctagtgcccatccctcttgattgcctgcataaaccgttcctcgaatgagcttcacgtgaaacccggcctcacgcaagacaaaataaaggaaaccatttagatcgtagcataggccgccgtgctgatctttgagcagacgtcgccatagctcttcttttgtgatcttataattctcttttgcaagtacggcacggttttcgaatggaaaacggtatgccattgctttgagaaaaaggggaagatcgccgaagctgacatgatctttctcccagccaattttctgaaagcagtcttttagaaagtcactcatttttatcacctaaacttcttcttgaacgtaagcagccagcttctccagcgcctcttgttcatcttctccctgggcaatcaaggtaacctcagtgcctgtgcttaccgcaaggctcatcagccccatgatgcttttggcgtttacttttttcccatccttctcaagaaacacatctgacgtaaaccggtttgcttcttgtacaaacaaagcagcaggacgtgcttgcagtcctgtctttaatcgaacttccactttctgttgaaccataagatctccccttttctttacggttattttaaagtgacggtttgccctgtccgcagctgttctgcgatttcgtcaagttttctcagcctgtgattgatccctgatttgctgattttcccgcttgctaccatttcccccagctctttcagcgtcacttcctgataatcaatccgaagctgcgcaatttcccgaagtttttcaggcagcgcctccaggccgattctttcatcgatgtatttaatattttccacctgtctcagcgatgcgccgatcgttttgtttaagttggctgtttcacaattgacgaggcggttgaccgaatttctcatgtcccgaacgattctgacatcctcaaatcgcagaagcgaattgtgagcaccgattacgtttagaaactctgtaatcttttcagcctcttttaaataggtaatgtagccttttttccgttcaagcgttttgctgtttaactgaaactcatttaacaggtcacataatgaatcgttatgctccttataaagagagaagatttctaaatgatacgaggaggtttccgggttattgaccgaacctcctgccaaaaatgctcctctcatataagaacgcttgcagcatctctttttgaccagctctttcgaaatacttcgttcaaacacaaaattctccccgagtatttttaaatcctctaagatcgcttttgcattttctgaaaaacgcacaatatagacgttattctttttcagccgcattttctttctgaccagcagctcgaccgacacatcatattgttttttcagcaatgtatagatgcggcgggcaatcgccgcgttttcggtttgaacatcgagtacgagatggcggtttgtaaatgataaagctccattcatccgaatgagtgcagacagctcggcattaatgcagcagtccttcacttccagattcgttaattctttttttgtttctgatgcaaatgacatatagccacctcatttcaaggcttcattctttcagtaaatcaacaagaagagaggccactttatgtgtatcgtgacgtattacgtcatttttatacgttacaatttgatctctgatgacttcaagccccatcgctttcagctcttcgatatcaaaatcaacaggacgcgccgattccatttcgtacttacgttttatttcgtcgggaatgtcttcactgttcactaatatcgtatcaataaaaccgcagcccatatgctgattgagcgctttcacatgatcagcagcggtgtaatggagcgtttcgccgggctgagtcatcacgttgcaaatgtatacttttttcgccggcgcctttatcacttcttccccgatttttgggacgagcaaattgggaagaatgctggtatagaggcttcccgggccgataataatcaaatccgcttccctgattacgtctattgtttccggcagcggatcaatctgttcaggcgtgagaaaaacacgcttaatgcgctgtccgtattctgggatcgttgactcgcctgagaccacgcggccatcttccatctcagcatgcaaaacgacactggcattggcagccggcaaaacctttcctctgacattcagcaccttgctcatttctgtgacagcgtgaaaaaaatcaccggttatatttgtcatcgctgccaaaatcaaattcccgagagaatggcctgttaagtcattccctttattgaagcggtgctgaaaaagatcttcaacaagcggctccacatcggataaagcggcaagcacatttctgatgtctccgggaggcggaattttcagttcattccgcagacggccagagcttccgccatcatcggcaactgttacaatggccgtgatgtcaacaggtttatgctttaggccccgaagcaatacagaaagacctgtaccgccgccaaagattgcaattttcggcttttgtcccatcttatttccggcttctcttttcaatgtcccggtgagtaacatgagtatagtaatcctttttgaaataatcagctaaattctcggctaatgtcacagagcggtgctggccccctgtgcagccgatcgcaatgacaacctggctttttccttctcttttataagatggaagcataaagctcagcagatcaattaatttctcattgaacttttgtgtttcattccacttcatgacgtaagaggaaacttctttatccttgccagtcagcggccgcatgctttcgatatagtacggattcggcaaaaatctgacatcaaagacgagatctgcatcaattggaataccgtatttaaaaccaaatgacatgacatttacggtaaatgtctctccttggtttgtcgcaaagtgcttcacgattttttcacgcaaatcacgcggcttcatgtcagacgtatcgtaaatgatttgagagcggccttttaattcctcaagcagctctcgttccagcgcaatgccttcaagcggcaggccagtcgctgccagcggatgcgagcgtctcgtttctttatatctcgtgacgagaatggaatccttcgcgtccaggaataaaattcgcggtgtgatccacggattttcggccatttcatccagcgcttcaatcagccggtcaaaaaattcgcggccgcgcagatccatcacgagcgcaactttgctcattttcgaatttgattccttcatcagctctaaaaacttcggaagcaatgaaggcggaagattatcgacgcagaaatagcccagatcttcaaagctttggatcgcgacagttttccccgctcccgacattccagttataatgacaagctgaatatcatgtgattcactaacactcatctttctcccccctgacttgtctttctatttgatgtgctgcgggtctaaacgataactgagtagctcaaattccggtgtatacgtaaatgtgccgtgcagcagcccttgtcccttcatcataaaatcaaggatatggccgtctccaggggccataggcaggttctgaatgtcattgacatcgtgccactgcagtttgccctcctctgattcagacacattttgtcctgtataagaatcagcgacaaacgtaaacatcatccactcggagacaatgtggtcaccgtctttaataataaaggtaaaaacgccttttaattgaggatttatgatatagataccagtctcttctctgtactctctgatgacggagtctctgactgattctccgctctccatcttgccgcccggcgcgacccaccagccgcgtctcggcttttgaagcagaagaactttgtcatccgtctgaagcacacaatttgtcactctttgcaagtacgtcacctaaccttcgtcctgtcatcgtctatttattataccgcttcaagatgcctcccacaatgaagagacattgacaatcttttcttctattttacagcatattcattccttaattcagatgattttgctgtaactggaattctcttttatttatggacaaaaaaaggacacggataactggagaatccgtgccaaaaaagtgtattcattataaaaagggggtcaattactttattaatcataaccgaaaagcattacacatgtgttacagcggaattaaaacccagtaacgtaatgtgaaactcgtatgacagccctttttattttaaggttttcagcgtttcttggagctcttcgacataatgctgtacgctttgtgccgcaatgcttccgtctcctgtagccgttacgatttggcgcagtgatttttcgcggatgtctccggcagcgaaaatcccttcaaccttagtttccatgcggtcgtttgtttcgatatagccttcttcattcgtaatgcccaggttttcaaacggtttagacagaggaagcatgccgatgtaaatgaatacgccgtctgttttgaattcactttcttcaccggttaccgtatcgacaagcgttacgttaccgactttgccgttttcctcatgaatttccttcacagttttgttccataggaagtcaactttttcattatcaaatgctctcgcttgaagaatactttgagcacggagtttatcacgtctgtgaacaatcgttacttttgaagcgaaacgagtcagatatacgccttcttcaaccgcggaatctccgccgccaacaacgacaagttctttgcctttaaagaaagcgccgtcacatactgcacaataagatacaccgcgtccgcccaattctttttcgccaggcacgccgatttttttatattccgcacctgcagcaatgatgacagcacgggctttatattcctttgaaccagctttgactactttgtactctttgccgtcaatgacctctttaatatcgccataagcgtattcagcgccgaattttttcgcgtgttcaaacattttgttagaaagctcaggcccaaggatactttcgaatccaggatagttttctacatcttccgtattggccatttgtccgccaggaattcctctttcaatcattaatgtcgataaattcgctcttgatgtgtatacagcggccgtcatcccagcagggcccgcgccgattataatcacgtcataaattttttcttctgacacactattcactccttaaaccatcttttcaagtttgggctctttcttataagataagaatccccatcaaacgtattccttacccatatcctataaaatctcatggtgatacgctatttttttgctcaacacgattaaatgtattcgaaaagggtatatgttaataaagaaagagccttctgttttagaaggcccttgtcatatttattattgaacaacacgtcttacaacgcctttaaatgcttttttccagtaaggattgctcatagagtcaacagatacgccatgagatgtattgtcgtttaggaaagtaccgtttcctaagtagattcctacgtgtccatttgttttgtaagtgtcaaagaacacaaggtctccgcgtttcatttcagacgcgctgacagcttgtcctctgccaactaacgtatcagtagttgttccgcctacaggtccaaggttaacacctgcagaagcgtatgcccagcgtacgaatgatgagcagtcaaaaatacggttgttgatatcagattggctgcgtccgccgccaaacttgtacggagattgtcctacaatgcttgaaccaacgctgatcgcgccttcaattccgccagagttgctgataacagtgccgcctgaattgctgtttgagccgctgctcttcttagaagatgagccgtttgacgaactgtttgatgaaccgttagaagaattgtctgaagaatcatcagatgagcttgcttttgctgattcagttgtcgccgtttgactgtcatctgtttgtgtttcgtcagatgctttttgtgcttcttcctgctttttgatcaaagcagccgctgcttcttgttcttttttgatgcgtgcttgttcagcttcagtatttgctttttgatttgcaagttcagacgcctctgattttaattcagaaatcgctttagccgttttcttctggcttgcttttgcttcgtcgaaaagcttgtctttttcattaagctgtttatcaaggtctttttgcattgtttctaatttagccaatgcagcttgaacttctttcagcttgtcattcaaatccgcttcagaatcctcgagcttcgctttatcctgctcttgctgtttgattaaatctttgtctgcgtccacaatagatgaaaccgcagtcgcacgagagataaagtcaccaaagcttgttgatcctaaaagaacatctatgtatccttgagatccgccgctttcctgtaaagaacgaacgcgttttttcaggatttcattgcgtttttcgatgcgtgcttcagtttctttaatctcttttttcagttttttgatttcttcttttgttttatcattttcttcttttttatcttcgatcttgttacttgtatcaagcgccttagcgttaatgtctttcagttctttttcaatctttgattgattttcctgaagttcagttaattctttttccttcgcttcaatgctggaagcaacctcagattgcttgctttcgattttttgtttcttttcatctaatgtttccgccgatgcagttttacttgtaaatgggatcaaaaaactgcttgtcccgatgacggaagccaaaccaagtgtcaataaactctttctcactttttatatcctcccttttactgtgaacctgtcctcatttggaatcgtattttgaacatcaagtttcgttcctcatactctacgaggaatgatggttgtttatggttaattattctgtgcatctcttattctggttgtatagcgtttatttcacatcatatgtaaaaaacactaattccttatgtacgagaatcattataccatcaagtttcgacaaattagcgataaattttattacatttatgtttcaaacagatgtcaagtcacacatcatttgtcatttttcttaagcgtgcaaaaaaactgtcgatattattttttaaatataatctatcaaacaaaaaagagtcgattaaataaatcgactctttaaaatttactattctagaatatcatcaatatatttcatatatttcgtcaacgttgccggagagatgccgaatcgggccgctgtgtcttttttcgtgtcttgcttgccatgggcttctttccaaatataacagatggctgctgcccagcctttctcattcttcaacggagcagctgcacgaatttgctggatgacatggaaaacccagcagctcatgacttctgttttcatctcttctttttcagcttgctctaatagtttgaccgtttgataggcgaaaagtgcatcctctgaaacgtcagcagccgcggaatctccattcagaagcagctttacaaaatgattttcaaaaggagcggtgattctctttgagcgtatcaccgcttcaagatgctccgtttctccctttgtgctgctgatataataggctgcgagacgctgttccacagatgaaggaagagcttccctccgctcaatccaaggcgccgggcggtcttcgccgggatattgcgactcgacttttctccagatcgtctcggcaaagtcggtatgtcccgtaaaataagcagagcaggaaagccagtaaaagaaggtgtcgtcaccttcaaagccggttttatataatgatttgagccatttatatccgatctcgtagcggccgacaagcgccaaagtagcacccaatttataacgctgctccattagcatcggatagacattggagagctgatcactcaattccaccactttttcgtcttctctttcataatagtagaaaacgagaagattgcataaggcgtgaagatttccttcattatgagaaagcacttcataagcggtttgcttcgcttttacaacgtttcctgaatagaaataggcaagcgcgagattgttgtatgctgaccaaagctccggatattcagctgtgatttcctcaagcgccgcaaccgcttcagcaagctggccgctttccagcaatgactttgcccgatcctgtttcaccagcagttcatcctgatcatacaacgaatcctcaatgccgtcgtctcctaaatcgagcaaatcaagcagactatcgttttcttcggcgaattcaccatccgggtccgcatcagaataagcggccgcttccttataagcttcctggaagagccccagatgggcaaagttattcgctttaaagtaatggcactccggcatttcggcctccagatttgccatgatatagtcaagaagatcgttcgactcttgatattggcccatttccgaataaatgaccgcaagctgtgaaagcatctctgaatcctccggctccaaatgaaccgcgcgctgaatcagtttgcttgcccgttttagattgcgctctttatacgctttcaagcctttatgaaaaaaatattgtccatcttgaagcagctggacaatttgtgcgtgatttttatgttcagaagtgtgttttcccacaactaccctccgttttatacaatattaccgtcagtagtataccataaatcgtaagcccctcaatagttcaaaaggaaggattgggaaaatccctcctcttttttattggctgattcgaccagaatttacccggctttgttttctaagtccgcattcattttcagctgctgttcagcaaaatccctataaagaccatgggaagccattaactcatggtgtgttccacgaccggtaatttcccctttttcaacaaacaaaagctggtccgcatctacaacggtagataggcggtgagcgatcacaatcgttgtgcggccctccatcagcacctcaagcgcctgctgaactgatttttcagattggctgtcgagacttgaggtcgcttcatcgagcataagaatgcttgggttacggagaagcgctctcgcaattgcgattctctgcctttgtccgcctgacagcataatgccgcgttcgcctacttctgtatcaaactgattcggcagctcctttataaaattgagcgcatatgccatctccgcggctttttcgatctcagcatccgtcacatctcgttctaacccgtagcaaatattttctctgattgacccggacattaacgggctttcctgcgatacatacccgatatgctccctccacgattcaagcgagtaagtatcgaccggctcgtcccccagtcgaatggtccctgcagtcggagtataaaaacgttcaagcagcttaaacagcgtcgttttccccccgccgctcggaccgacaatagctgtgactttacctgcttcaatgacggcgctgatttcttttaaaatcagctgatcaggcttgtatccaaaagacacgcgatcaagctgaatagggagatgcgcattttcaatttgttttcctgtcactgtatcttcttcttcctctgctaaaatctcaatcattcgttctgttgcaccgattgatttttgcagctgtgtgaaaaacgttgtaatctggcccatcggcattataatttgaaacaaatataaaataaaagccacgagcgctcccgccgtgagttcgcctgaagatacctgcatgccgccatatccgatcactgcgacaagcgctgccattagcacgagtgagataagcggaccgacaagtgattgaaccttagcttctcgaacgccaagcttaaataatgatgaaatccctgttttcccgcggccgtattcgacatcctccgcatttgaagctttgacaagtctgatttccgggagaatttgattcagcaggcctgtaaaacgggctgtttcatcttgtgtttcccgtgaaatggagaacattttccgtccaatcggcaccaaaataagagcggccagcggaacgaccactaacacaagcagtgtcagcttccagttcataataaacaagattgtcaatgatccaatgacagaaatgatgcctgtaataaatccgctgatatgggttgtaatcaattctttgaccaccatcgtatcgttcgttacacggctgactgtttctccggaagcatttgtatcgaaataagagacaggcagcttaattaatttcttccataataactcccgcagcccggaaatgattttttgtccattatagttaagcgcataggtggcataagcgcttaaacccgcctgaacgaaaaacaccagcgcgatcaaaccgatttgcgtgcctgacagatttgacatagaaaaaccatcgacaagctgcttcgttaataatggaatgagcaggctgaccagcgtggttactacactgagggcaagcgcaaaggcgagctttccataagaaggattggtccgtcttactaaggcaaaaaagggtttcaatttacttttagatttttgtttcttggttggcatatattttcctcctgtttcagcgttcagaaaggtgaaaagtcatagcaaaaggatgatttttactctttctcaatcatatcaatggagaaagactttttcagtatatttttgccgtgatcaaaataaaaatctcccactcattgtttgaataggagatttttgtgttagacatctttcactggcttcttttttctgtaagtcaatgttacatcctgctgtcgcaggtcttctattatcattttgtaccgatcaacttttgcggtatgttcttcttttatcatctgaagggcagcttttcgtttttcgctattagactcaagctctttttttattttttttacaatcaaccctttttgccctttgatttcctcttttaatgaagactcaaatttctttgtcaggctgagaaagtcgttgatcggttgattgagggtgcccgctttccccttcatttcatcttgggtaagaaacatataggtcgttgatacaatttctgtttcactttctgaaaataaggaagtcactcttcatattcctcctaagactgaaaatcaaataactgagaaatcatttcttctttttcaaacagcttttcaatactctcgcggatatttttgataaaatctcttttttctgttgtctgtttttttaattcagcaacaattccatcattagcaggaagcgcacctgtgtggaatgattcatgaactgagattttctccaatttatcgaatgtgtggctgaaaccagctgcaagccggaattgaagatcgaaggcataatgcgaagggttttcttccatatgatgaatagccgtgatgatcgcctgctttttgtctatgaagtcttcatcgatttcctgactgtaaaccttctggtacttagaaatcgcatcttccatatcttcaacgattttcataccgttttgatagattctgacagcggatgagagattgacttgaatcgtttctcccgagccactcttccctgtaaaataaatatcggagcctttatagctgaagcctttttcctttgacaaggcgttgagcatttgaacgatgctgtggccgtcgacgataagttttagtgcgtcttttgtttctgtgtcgagtgttttcaatgaggacagaattgattttacatagtccactatttcaccaacgtcttttaaagcttgcataaattggccatattttagatggtctatgaaatgttcgtaccgtgactctatgcctcgcatactcgcattaatattcgttaattcttttttgatgactttcttttgcgtttcatcaatataaccattttcagctaactgatctacgaccggtccgctgtttctcaacaaggtatgaagaaaacctaaaaacgacggcagttcctcttttattcggccatacatttgcttaacatcatcaaaatgctcatataggacacttactttctttaaagcgccgtctgtgtttttcactttttcaatcaggtctatgtctatcccgctggctgcctttataaaaccgttcaagccgtctttttcatagtcatccttatatttttgaaggaatttttgaattgacctcacatcttcgtcaggaaccccatccataatgtttcggatgccttttacacttgtatttgtatctgccatcttcacatcaccgaatgtaataaaatcggccttgccgctgactccatacagcgggtcatcttttgagatgcgctgagtgatgtttgttgttacgcctttgtcttcataatatttttggatttctttttttaacttttctggcgggatggaatctatatcttcatatttataactaaatttcctaataacatatctatataaactttcatcagtttcaagtaattgatcaatattgacttgagctccatttaccccataaacttcatcatattctccatcaatcaattgcaccataacttggttattatttgcaagtgaatgtcctaaggcgaatgtttttaaatcctcagagttacctgctgctttctttgctttgttagtaaactcctttgtagcctcatactgactatgatcaattcctaaaaaaagaccaaaaaagttatatgaccaatccttattatcggcactaccttctgaaataatctgaagctgatcaatatgttttttctcatctattatatggattgccgttccatcgtaacctgattctctggtcgaactttgtatacttgtattctgatttacaagttcattggaggtgtaaatttcaattttcatattctcaggaagatcgtggtgggtttcctctttataaattctgcgtatatctgcttcgaaatccttcttagctttcttaacttcactcgcaatagttgaggcaaacttttgtttatagtcatattctaaatcaattaaccttaactttacgttctcattctcaaatacatttttatttcccatcttatttctcctttttatctattaaaaaggtgatagaattaattaatttctcaactttatttttagccttttcttcatctaaggagcatggttgattttcatttttgcatccaagggtaaaggcgtattctactcctaggttatcttcctctgtagacttaacatatccaaaataactgtatgaataattatattttctatcaatatcgtcaaagatgtcttttttcttggcagtgtaaatatccgttttctttttgctgctttttttgtattcgcctttataatcattttttccactaacaatatctagcattgtcttaggttcattcgcaaaactttcttctttgtaatatgttacatggccatcaaacattacattggtgtctttatcataactattaaatccaatactttctttgtttttcccggttaacgatgatcttcttgatagatactttccatcctccggaaacaacatcctaaaccctttcagcttagattccagcaaataatatcctggttcctcttcttttgttgacaccatgtactctctcgttttctcgtcctgaaacgcaggtacttgaggcagatccttgggatccatgtcttttggttttaccgcttctgttttattgtcatttgtgctgtttttatcattgtcattcatactgcatcctcctgtcagggcaagtaataagctgaagcaaataaagatgatctttttcattacgaacctccacgggttttgtgagaatagtattctatttttatatcaaaaataattctattgacctggttaagagatgattatttcatcctttttcatgttacatcatggcggaatttggataaataggaaatgagactcggttttgatctccttttattaactaatcatatataacacccaatataaatctaaatacctattacttttttcacaaaacaaaaagagccgtatcatccggctctttactcttcaatctcagaatggcgttttttcaatacgtcaagcacatcatccagcggcagggattgttctctgagcaggacaagcaggtgatacagcaggtctgccgcttcccatttgagttcctcatgatcccggtttttcgcggcgatgatgacttcggatgcttcttctccgacttttttcaaaatcttatcgacgccttcacggaagaggtacgtggtgtaagctccttcaggcatttccgcttggcgttccgcgatcacccgctccagttcgttcatgatgccgaatcggtccgcggcctgttcttctgtttgttcctttgtaaaacagctgtagctgccagtgtggcatgccgggcctgacggttctacgagtacgagcagcgcgtcttgatcgcagtcataccggatacctttgacggcttgcgtgttccctgaggtttctcctttatgccataacgcttggcgtgagcggctgtaaaaccatgtttccttcgtttccagcgttttttcgtacgattccttgttcatatacgcaagtgtcagcacttctttgcttgccgcatcctgcacgatagcaggaattaatccgtcctcgttaaaacgcagttcatctgcctgtttcatctcacattcaccccgtactctttcaagtatgatttcacttctttaatcgatgtttctttataatgaaaaattgaggcggccagcgcggcgtcggcttctccttttgtaaaagcctcaagcatatgctgtgcgtttcccgcgcctcccgaagcgataacagggacggggacagcttcggaaacaagctttgtcagcgtgtggtcgaaaccttttttctcaccgtcggagtccatgcttgtcagcaatatttctcctgccccgcgtttgacgccttcttttgcccacgcggtgacctcccaatctgttttctttctgccgccgtgcgtatagaccttatatgtgtcagattctttgtcatacttggcatcaatggcaagaacgatgcattgcgaaccgaaaaactcggctccttctgcaatcagctcagggcggagaacagctgccgtgttcaccgacactttgtccgctccggcacgcagtatcgttttcatatcactgagctgattgatgccgccgccgactgtaaacggaatggcaagcttcgcggcaacctgctccacaacgtcaaccatcgttttgcgtccttcatgcgaggcagaaatatcaagaaaaacgagttcatccgcgccttcccggtcgtacacttccgccagttcaactgggtcaccggcatccttcaattcgagaaattgaattcctttgacaacgcgtccttctttgacatcaaggcatggaataatccgttttgtgatcatttgcgcttcaccctttcaagcgcctcacacagcgtaaactgattggtatacagcgcttttccgatgatcgctccagagacgccgtccgcctcagagcgggcgagagcttcgagatccgcgacggagctgactccgccggaagcgatcaccgatttccccgtttccttagcaagctcgaccgtgcttttaacattggggcctgacagcattccgtctgtcgcgatgtcagtaaaaataaagacttccgcaccttcattggctagctctttgcccagttcagttgccttaagggttgatgtttccagccatccctctgttgaaacaaaaccgtttctcgcatccagtccgattgcaattttctcgccatattgtttcagcatttttttgacaaacggagggttagaaactgctgagcttcccaggatcacccgatcgactcctgctgataaatattcatagacgtcattttcggaacggatcccgccaccgatttcgactttcaggttcagcttttgcgtaatctcaatcacatggcggtcattcactcttttcccttctttggccccgtcgagatcaacgagatggatccattcggcaccctctttcgcaaataactcagccatgtcgtacggtgaatcgccatatatcgtttccttattataatccccttgaacaaggcggacacatttgccgtttctcatatcaattgccggatataatgtaaaagcactcattttttcaccttctgttctgctgccattttcgtaaattgagttaaaatagacattccgaccgtgctgcttttttccggatgaaattgggcgccgaagacgtttctttttccgactacagcaggcactcgtacaccataatcggcgcttgccagaagcgcgttctcctccatcccgtcaatgtaataggaatgaacgaagtaagcgtagccttgttctgtttcagacagcagcggagattcgttatgaaaggaaaggaggttccagcccatatgcggaaccttcagcttgtttcctttttcatcttctgctttcagcctgactgcttttccttttaacagcccgagtcctgaagcggtgccgttttcttcgctttcttcaaataaaagctgcatgccgaggcagatcccgagaagcagccttccctctgagaccatatcgtgaatcaattgatcaagcttcgtgtagcgcaaattgtccatcgcgtctccaaatgaaccaactcccggcaaaatgaaggcatcagcttctttcagctcctccggcttttcagaaacaaaatacggcacgccgacacgttcaagcgcctttgagacactgtataaattccccattccgtaatctatcacgccgatcatttacagcatccctttcgttgacggtattcctttaactcgcggatcgatcgttgtcgcttcatcaagcgcacgtcccagtgctttaaaaacggcttcaatcatgtggtgggtgtttgtgccataatgaacgatgacgtgcaggttcattcgagcttcgagcgccagcttccacaaaaattcatgtacaagctccgtatcgaaagttccgactttagcagccgggaaatcagcgcgcatttctaagtgcggccggttgcttaaatcaatcacaacttgagcaagtgcctcatccatcggcacaaacgccgatccgtagcgtttgattccttttttatcgcccaacgctttgagcagcgcctgccctaagcagatgccgatatcttcagtcgtgtggtgatcatctatatcaacatcgccttttgcgttaatggaaagatcgaattggccgtgtttcgtgaataaatccaacatatgtgtcataaacggcacatctgttttgatatccgcttgtcccccgccgtctattgtaaatgccagttcaatatctgtttcgtttgttttcctgacgcgttccgcttttctcatttagaaatcctccgttctctcgcttcaattgatctggcatgggcttctaacccttccagtctggcaaaagccgcgatgctttcggcatgttcttcaaaggctgattgactgtaagaaataatgctcgatttcttttgaaaatcagttacgtttaatggacttgaaaatctggctgttccgtttgtcggaagcacatggttcggtccggcaaaataatcaccgacaggctcagggctgtatctgcctaagaaaattgcacccgcatgtttgatactgccaagcaaagcttccggagactgtgttatgatttctaaatgctctggcgcgagtgtattgacagtattaatcgcttccaccattgtttccgccacatatatacaaccgtaatctctcactgaagcttccgctatttctcttcgcggcaaggttttcagctgcttactcacctcggctgaaaccgcctcggccagcgccatggaatctgtgacaaacacacatgagctgagcttatcgtgttccgcctgtgacagcagatcggctgcaatttcgctcggaatcgctgtttcatcagccagcacgacgatttcactaggtccggcaatcatatcgatatcgacatcgccgaacacttctcgtttggcaagcgcgacataaatgttgcccggacccgtgattttatccaccggttcaatggtttctgttccgtatgctaacgccgcaatcgcctgagcgccgcccattttgtaaatatcttttatgcccagctcggctgcagcaaccaaaactccaggagacagcagaccgtctttttccggaggcgtgacgagaacgattctttcaacgcccgctacgagcgccggaatcacattcatcaaaacagatgaagggtatgcggccgttccccccggcacatatacaccggcggaatccagcgccgtcactttctgccccagcattgtgccgtcctttctgtgataaaaccaggaggattgcagctgtctttcgtgatattccctaatattttcgattgcctgcctaatcacctgaagaagacgtgaatccagtgaggtgtatgcctcctcaaattcttcttttgtgaccagcggactgtctatttcgatgccgtcaaatttcgccgtgtagctgcgaaccgcctgatcaccgtttgctttaacatcttctataatggaccggaccgtctttctttgctcttccgttccggcatcgatggaacgcttgagagaaagccgttccgctccgctgatggttttgatcttcattttgccgtctctccttccacaacgagagataggcgggatgccatttcgtcaatcacatcgtctttcatgcgatagcttaccgggttgacaataaagcgagaggtaatgtcacaaatgtgctccgtttcaacaagcccattttctttcagcgtctgtcctgtggaaacaatgtccactatccgatctgcaagcccaatgagcggagccagttcaattgaaccgttgagcttaataatctcgacttgttctccctgctctctgaaataactggaagccacattcggatactttgtcgcgattcttggcgctactccgctccagtctgtattcggaagtccggcgacagctaagtggcatttgctgatttttaaatccagtacctcatacacgtcgcgttcctcctccagcatgacatccttgcccgcaattccgacgtctgccacgccatgctccacatacgtagttacgtccatcggcttcgctaatatgaaacgaagattttcctccggcacatcgatgatcagttttctcgaatcttcaaactcctcagggagcctgtagcctgcctgcctcagcagccctgccgcttcttcaaatatccggccctttggcatcgccattgtgagtaacttacccattttgctcttcctttctggcaccgataaaataagtgacgtttgcaaaagattttgtcatctggtcgatattttctattcccgataaatcttgaagaaccactttgttccctttcatgcgttcttcattcgcataagcgatggcttgcgcccgctgctctttgctgaaaataacagcgtctatatcacaaggttcttctttcatatgaagggcttcaatcagccggtcgatccgaagcccgaagcctgttgccggtgcaggtgaatcaaaatggcccagcagcttgttgtaacggccgccgcttccaatgacaaaaccgacattctcggcgtacacttcaaataaaatccctgtgtaatagctcatgtggctgaccatattcagatccaggcggacattttccgtacatccgtaatcctcaagaatgtcccacagcgccttcagctcatcaaccacgctttttccttgcgcagaatcgacgatttcctcggcacgtccgcatacttctataccgccccgcagttcaaggagctcaagcagcctgcttttatcaatggaggaaagcgggagagacttgacatgctctctgtaaccgacgtagttcttttcatataagaacctccgcagcacatcagctcgttcaacgttcccgagcacctcaacaaacaaagcatccgcaatgccggcatggccaatggcaattttaaaggatgccagcccagcgtttttcaatgccccgacgactaaagcaatgacctccgcatccgcgctcgttgtgccgtcaccgattaactccactccgacctgctcgaactcagccggacgtccgccttcacgctcctgagccctgaatacatttgccgcatagccgactcttagcggatgaccgtgtttcagaagcttcgatgccgccacccttgcaatcggccccgtcatatccgggcgaagcaccaatgtcttgccgtcctgatcaagtagcttaaacagctgctgctcttcaattgctgactggacgccaaccgtatcgtaaaactccagtgtcggcgtttccataaattgatatccccatttatcaatcaaatcggttaacgatcgtctcaccttttttttcgtttcgtataaaccgggcagtgtatctctcatgccgtgcggtttttcaaacataaacatcaacccgagcacctccgctgttatcttatgaaggaaaattccgaatcctttagttcgctaatatgataatatgttagcagatgaaagaatgaaaatcaacgcttaacttcagtaaggatatttttagttcaaatatccttctcctcattatgaaaaaatcatgaataatgtattaaaggtacgtaatatctcaaattctttatgtttggcatgctataatacaaatcaaatagagaacaaggagataaagatgaaaacactgcgaactctatgtgtcctgatgattctttcaggcgttatttttttcggacttaaaatagatgcaaaagatatagatattccttttttgaacagccttaaaaaagtggtttctgatagcgatacagatacaggtgcgaatagcaaaaaggagctgaagggaagcgcaaaaccgctggatgtcatcctttacaatcaaatggacgcaccccggctctataacggctgtgaagtaacaagccttgcgatggtgctgaattacgcaggatacgacgtgacaaaaaacaccctggcaaatcaggttgccacagtgcctttgacatacagcagcggattaaagggtgatccgaatgacggatttgtcggggatatggcgaatggccctggtctcggtgtctaccatcgaccgatctatcagctggcgaaaacctatgcgggagacaaagtgtctgatctgactggaaaaagcatttctgctgtttatgaacagcttgaaaaaggcaatccagtttgggttattacgacagccaactttacgccagttgacaacatgcagacatggaaaacaccaaacggaacgatagagattacgtacagcgaacacagcgtcgccgttacgggatatgatgataaatatgtgtatctcaatgatccgtatggctataaaaacagaaaaaccgatagaacaagctttgaaaaagcgtggaaacaaatgggcagccaggccatagttattcaaaagtaaacgcctgaaagccgcactatgctctatcctgagcaaatacgacaatattcatgctttttgtttcaatcggtaagatcgattcattttccatttatcatccagaattatctttactttcaggctgtctgtttttatgattaaagcagattcagccttgccccgatctatgtgagagaagccggtgcaagtcgctgacgcttctcttgcaaaaaatgaaagatatccggggaggatttatcattgaaaaaattcgtgtctatcctatttatgttcggtttggttatggggttcagccagtttcagtcatcaaccgcttttgcagcagacaaagtggtgcacgaaacaattatcgtaccaaaaaatacaacatatgacgggaaaggacagcggtttgtggcagggaaagaattaggcgacggaagccagtcagaaaaccaagaccctgtttttcgtgtggaggatggtgcaaccctgaaaaatgtggtgcttggcgcccctgccgctgatggagtacacacttatggaaacgttaacattcagaatgtgaaatgggaagatgttggtgaggatgcgttaacggtgaagaaggaaggaaaagtgacgatcgacggcggttctgctcaaaaagcgtcagataagatattccaaatcaataaagccagtacattcacagtgaaaaacttcacggcggacaatggcggaaagttcataagacagcttggcggttcaaccttccacgttgatgtgatcatcgataagtgcaccatcacaaacatgaaggaagcgatattccggacggacagcaaaacaagcacggtcagaatgacaaatacacgctactctaatgtcggtcaaaaatggattggtgttcagcatatttacgaaaacaacaacactcaattttaaccaaaaaagtccgctgatgttattcagcggactttttcaatctttcttgcatttcttccttcgtatagatgatcctcatcggatttccgccgacaaatgcgccggcaggcacgtctttatggacaagtgttccggcggacacaactgcgccatctcctattttcaccccgggcagaatggtcgtgttggcaccaatcatcacttcgtctccgatcagaactgtgccgatccggtattcgtgaatcaaatactcatgggccagaatggtcgtattgtacccgatgattgtatttgttccgactgagatcttttccggaaacatgatatctggcatcaccatgagggcaaaggatgtctgatttccaaccttcatccgcagaaatgtacggtacagccagtttttcatccctataaacggcgtatatctcgcaatttgaatgacaatgaaatttttgacgacctttaaaaaaggtaccgtttgatagacatgccacagtgagttggcccccgagaccggatgacgatctgtttttctcacagattacttcactccaacgatttgtaatagatcactcattttctcaagcataaaatcaggctcatgcttcgccagcatttccggccctttaatcgtccatgcgactcctgccgtttttgtaccggcgtttttgcctgccagcacatcgtggtaattatctccgaccataatggcttcctcgggcttgcttcctaactgtttcagcgctaacagcacaggctcgggatcaggctttgcatttgtcacatcatcaagggtgacaactgtttcaaagaattcgccgattcccgtgagcttgaggcccatattgacagtatctcttaattttgttgtcacaattcctaatgtaaagccggctttttttaatgcatccagggtctcatataccgtttcatattcagtcacgagtgaatcatgcatgtcatgattgtacgctctgtacatagcgatcatatcctcgcatttatcagggtccatcgaagagaacgtttcaaaaagagacggcccgataaatgcaaggacatcttctcgtttatacttgctcggataataatgctccagtgtatgcaaaaaggacgcgataattaattcattcgtattaataagcgttccgtctaaatcaaacagaatcgtcgttacttgtttgtcactcatattgcttcctttccaaccgctgagggtttccattttttccacgtgtgcgcaatagccattgtcagcagaactgctgtggtgacacgaatcaaaagaagcggccagactggtatgccgagcggaataaagacaagtgtatcttccacgaccgcgtggcaggcaacgagaaatataaatgccaatgtcatatcccgcttgctcacgccgtcatcctcgacagctttgatcatgacacccgctccgtaggccagaccaatcgtcagtcccgccaccatcgtcatagacgtatttttattcatgccaagcagctgcgtaaacggcgacagccacctggaaaaccgatgcagccagcctaaatctcttaaaaactggatgataatcatcagcgggatcactattgccgccagctgcaaaacaccaagtccggctttcgttaatgcttctgccaacattcctagccagctgtctggcgccgcgctcttcgcagcgataaaaccgtactgcgccgtttcctttccgccatgccaaatgaggttgatgacgatggctgacacagcggccaaaccgatgcgcacggccaatatgacgccaattctgataccaacctttgcggcaactgtcgattcgataatcaagttatgacagaaagaaagcataacagctaaaataaagacttctttcacagataaatccaatgttaaaatcccggcaattcccgcatacagattcagcatatttcccagtacaagcggaatggccgcttcaccagaaagcccgaagagacccattaccggtgtgatcagccgtacaagccaatccatgacaggggtatgctgaagcaaagtgaccaatagcgttaccgggaaaatcactttacccagcgtccatgttgtttgaaaacctgctgcaagaccggccagaaagatcttcttcatccctcatcccctttgttgacgtctactccgcgtaccgctccttcgaatatcccttgacgcgtctgaagatgatggctgccacagccaaaacaatcaatacgattgaaatcacctgagcgatgcgaagtgaatcagtcagcattaagctgtcagtccgcattccttcaataaagtatcttccgattgaataccaaatgatatagatcaagaacatctcgcctctacgcaaattcactctgcgcagcagcagtaaaacaatgacgccgacaaagctccatagtgattcatataaaaaagtaggatgataatattgcccattgatatacatttgattgatgataaattcaggcaggtgcaggttttctaaaaaggctctgctgacagcctcgccgtgcgcttcctgattcatgaagttcccccagcgcccgatcgcctggccgagcaaaatgctgggcgcggcaatgtccgcaagcttccagaacgaaagttttttcactctcgaaaacacataacccgttaaaatggcgccgattaatccgccatgaatggcaatgccgcccttccaaatcttaatgatttctcccggatgtgccgcataatagtcccattcaaaggcaacgtaataaattcgcgcgcaaataatcgcaattggaatggcaaacaggacaagatcaataaacgtatctttctgcagcccccgtttttcactttccctcatcgcaatccacagcccgagcaaagcaccgagaccgataatgattccgtaccaatggacggctaacggccccagctgaaatgctatcggattgagtggttctatcgcttcattcatttaacgccaactcctattcttcttgttcaccgtcttcaatgacgtccgccagcttgttggtaaattgttcagcggcattcagccccatccgcttcaatctgaagttcattgctgccacttcgatgatgactgcaagatttcggcctgggcggacgggaatcgtcagttttgtaatttctgtatcaatgattttcatggtctcttcctcaagtccgagccggtcgtattgcttgccctgctcccagagttcaagattcatgacaatcgtgattcgtttattgcttctgaccgcgccagcgccaaatagcgtcatcacattgataatgccaaggcccctgatctcaagaaggtgctcaattaattccggagcgtttcccacaagagtatcctgatcctcctgccgtatttcaacgcaatcatcggcaacaaggcgatgccctcttttcacaagctccagcgctgtttcgctttttccgacgccgctctttcctgtgatcagcacgccgacaccatatatatcgactagaacgccatgaattgctgtggtaggcgccagcctgctctcaaggaagttggttaaacggcttgacagtcttgtcgttttcagcggcgatctgaggacaggcaccccatttttctcggaggcgtcaatcagctcctgcgggatgggcatatctctagaaagaataatagctggtgttacatcagtgcacagagaatccattcgctgttttttctcctcttcaggaagctgttcaaagaaagaaagctctgtttttccgagaagctgcacgcgctctctcgggtaatatgtaaaatatccggcaatttcaatgcctggtcttgataggtcactcattgtaatcgggcggttaattccttcttctccgctgattaattccaaattgaactgttccattacgtcttttgtgcgaacctttgccacgatatgttcctcctgttccgggctgccccgagcttgctcacaatactttcattttatcactttcaggcttgaacctaaaacagattttataaaaggcgggaaaacacctcagctggtctagatcactagtctgaaaaagagtaaaataaaggtattcaaattccagaaaggcggatcatctatggcagagagtcttcttatcaaagacattgcgatcgtgacagaaaatgaagtaatcaaaaacggctatgtcggaatcaatgacggaaaaatcagcacagtctcaacagaacggcccaaggagtcatattcaaaagaaattcaagcacctgcgaattccgttttgcttcccggcatgattgacattcatatccacggcggctatggtgcagatacgatggatgcaagcttttctgcgctcgacatcatgtcgtcaagactgcccgaagaaggcacgacgagctttttagccacaacgattacccaagagcatgggaacatttctcaagctttggtgaacgcaagagagtggaaagcggctgaagagtcctctttattaggtgcagaactgctcggcattcatttagagggcccctttgtttcgcttaaaagagccggagcgcagccaaaggagtggattaggccttcggatgttgcgcttttcaaaaagtggcagcaggaggcaggcggactgatcaaaattgttacacttgcgccggaggaggatcagcattttgaactgatccgccatttgaaagacgaatcgattatcgcatccatggggcacacggatgccgattccgcattgctgtcggatgccgcaaaagcaggggcgagccatatgacccatctgtacaacgcgatgagcccgtttcatcaccgagagcccggagtgatcggaacggcgctggcccatgatgggtttgtgacagagcttatcgccgatagcattcactcccaccctttagctgcaaagcttgcttttttggcgaaaggcagcagcaagctcattttaattaccgattccatgagggcaaaaggcctgaaagacggcgtatatgagttcggcggccaaagtgtgacggtaagaggacgaacagctcttctttcagacggaacccttgccggttcgatcctcaaaatgaacgaaggcgcacggcatatgcgtgagtttacaaattgctcttggacggatatagctaatataacttctgcaaacgcggccaaacagctgggcatctttgaccgaaaaggcagtgtgactgtgggaaaagatgcagatttggtgattgtcagcagtgattgcgaggtgattctcaccatttgccgcggaaacattgcatttatatccaaggaggctgaccagatatgaaagtaatggaatgtcaaacgtatgaagagctaagccaaaaagcagccagaataacggcagatacaatcaaagaaaaacctgatgccgttctcgggttagcgacgggcggcacaccggaaggcacttatcgcgagctgatccgcctgcaccaaactgagaatctctcatttcaaaacgtcactacagttaatttggatgagtacgccagactttcaagcaatgacccgaacagctatcacttctatatgaatgaccgtttatttcagcatatcgacagcaagcctagccggcattttattccgaatggaaatgcagacgatttggaagccgaatgcagacggtatgaacagctagtcgagtccctcggcggcactgacattcagcttctcggcatcggccgaaacggacacatcggctttaacgaaccgggaacctctttcaagtcgcgaactcatgttgtgacattaaatgagcaaacccgccaagcgaatgccagatattttccttccatagacagcgttccgaaaaaagcactgacaatgggaattcgaacgattctctcaagcaaacgcattctgctgctcatttctggaaaaagcaaagcggaagctgttcgtaagctgttagaaggaaacataagcgaagattttcccgcatctgctttgcacctgcattccgatgttacggttttgattgatcgtgaagccgagtcattaagaccttgaaaggaacatgctgacttatgaatatcaataaacaatcgcctattccgatttactatcagattatggagcaattaaaaacccaaattaagaacggagagctgcagccggatatgcctcttccttccgagcgcgaatatgccgaacaattcgggatcagccggatgacagttcgccaggcgctttctaatttagttaatgaaggcttgctctatcgcctgaaaggacggggcacctttgtcagcaagccaaaaatggaacaagcacttcaagggctgacaagctttaccgaggatatgaaaagccgcgggatgacaccgggcagcaggctcattgattatcagcttattgattcaactgaggagctcgcggctatattaggctgcgggcacccctcctctatccataaaatcactcgggtgcggctggcaaatgatattccaatggcgattgagtcctcacatattccgtttgagcttgcgggtgaattgaacgaatcgcattttcagtcgtcgatctatgatcatattgaaaggtacaacagcataccgatttcccgtgcaaaacaggagcttgagccaagcgctgccaccacggaagaagcgaacattcttggtattcaaaagggagcgccggtcctattaatcaaacgaacaacatatctgcagaacggaacttcttttgagcatgcaaaatctgtatacagaggcgaccgttatacatttgtccactatatggatcgtctttcataaaaaaaaagcctccaaccctttttaaggattggagacatggcgaaaatcaaactggtctggtgctggacgatatgtctcttttttcgtcttgaacttccagatcggtgatttcgttttgccattaaaactgtcttccactataatgtaccaataataaacagactgcggttcaagatgatcccagcggaattcagctgtatccccgctcttcacttgctcccgttttccgagctcttcattggtatatacgttacattcaaaataatcggtttccacctttttgattcttggcttcaaatcaagcgaaagggaaaattcatccttgttgccataggtatccgtatcatagtaattcttatcctttacatacggagaatacgtcgatacgtgcaccatgtcattggcctggtcaaattgaagcaaacgcaaatacccttgaccgccttctggcccgccctgataatcggccagcatttgatgcacaagacgatccggcttcccatcaccatcatcatccagctcatctgtttttctcatcgcactatgataatgcccgctcaataccatcacgacattcgggttcggctttacgatttctttgaatattttctctccgattgggcttctgtttccgctgaccagcaaatactcatgaaaagctaaaatggccatccggtcagggtgtttcttcagcacctgattcatccacgcgatgtcttcatccgtaatgccccatcccatgtacagcatgatataatcattgccgttgctagaaatcaggtcataatgtccgcggttatttttataggaaccgccataatgcaattttttatcaaaacgatcgctgccaaaatatttgccaaacaccctgtaggagccgtccttatgtccgacatcgtgattgccggccagcactccgtaaggaattccgctcttatccagaacggacattgaccgatcagcgtttttccactgtctgatatcggcggaatcatctacaatatcacccgtgtggaacacatatttgatattgagctgcttttgattatcttttatccattcggtctgtttatcaaaaatatgcggatagctttcggcgtaatactgtgtatcagacatccagacaaatgtgtacatatccttcgcaggaggaatttcatcctgtacaatcacattcattttcgactcccgtacaaaatcggcggcaatcacagacgctttcagcgtaaacggtttgtcatccttcgcgacgaagctgtcaacaggctgccattcgtttgtccgataattccaagcatacatcgtcacctttctccccggcaaagaactgcccttccagaccgcttctgccagatcattctcatcaattgatggatcaaccgtcacttcaaagcgatgataagggaaaagctctttgttttctgtcgatactgtttttccatcagcagctgatacccgctccaattctttattcgtaaatggggtctccctttccggcacaaagcttttcggcggttcagtcagtgacgcgtgcttaaatattttcacatgattgcgcgctgtatattgaaatcccctataaaaaccaacatccatggcgtcattcgtcggatctttcacccgtacagaaagcttggccttatgcgtgtcggcttcgctgtctataacctccggctggtccggatgctctcgttcggttttaaatatcctctcaatcactgttttattgcccgcgagatccgttgctgtcacttttagagaatgttttcccggcaaaaggtcagaagatgatgtatgatatgggagtgtaatgctttctccatctaaagacgcttccgcttcctcaattttgctccatttatcatacatatccgcctgcaggataaggtttcctttatacgtttgcccctcggtgatattcggctcaatgtgaggtcctgaattatctacccgtacaaccaggctgacattttccttgccgtcgcttgcttgaatatggtgagcgccttcagaaagctttgatgtatcccactccagcagctgtgatgtaaatagtccgtcaggcagattgaactgaaattgccagcttttattcgagcgctgattatcgccaataaagagttccttctcaggagacaccctctgatctctgatcaccgttccatccgataacaccaatcgggcgtttttgactaagaagtcatcacggttttcagccgtatcaaacggagacaccttcgaacctgaacgtatcgtaatacgctgcagctgcttccctttccgaagcagtgtctctggcaatggaacagaataggtgcggtatttatttgttgtatcatcgaacaccttcagcactttgccttccatcgttaccgcgtttttaaaataaaggttcgttttcctcgtatcgaatgcaaaatatacttctttttccatcgcgggctctgtcacttgttttttcccgtcaatccacagcttaatgctgtcagctcgcccttctgtcgtggctttgagaaattgagttcccgacagcgtgtctctgttttcaatattcatccgcagaccgtgcgccttgcttgtttgtttaatatcaatcattttgaccggcgttctcgcttcattgatcccgtccccggccgccacataatactctagctgatccttcccgatcaattcaggcgaatacacaatataatggaagagattatcgttgcggtctttttcagcaagaattcgcttaaacggtttgttctcatccgtccggtagtaaaaggccgctgttttcactaggcttcggtcccgtatgtcagcccgcagctcaatgctttcagcagggcggacaggcttgcggtcagtccaatcctcaatgaccggcttttctttatcgagcttgattttccgtttctgctcgggcacctgtgcctgtaatacggttccgggagacggattcttttctccgattgaaatgttcagaagttctgcggttccgttcaacggatacttataaagcactgatgacagccggcgcagcgcatgtttccgataatgcgcaaccgaaatgtcctttcctgtattcgttgatatcacaacggcccgcggcctcgtattggccataccctctgtctcgtctatcaccgcgagattttttccttccgttaattgtgtctggtaatatcgattgaaatcctccgccgtcaattctggatgcccggcaggcttcagccagacgacaaacgtttcgccggatggtatcaagatcctttcatcaggtctccaaatcagatcggagtcaggcccttcttttgggtagcggtaacggatatggtagtctttaaaatcaatcgttctgtcagtcgtattaaaaatctcaataaattcataaccgtctgcgcgtcctatattcttcgtatcaaccgccagctctgtgatcagaagctccggaatatgggcaaggtcagcctggtatccttcaagcttcagtttcttcgtctccgactcaacccgctgcttcccattcgacatcacaatgtaatactcaagctcgctgttccaaatcaaacgtttcggaatttgtgccaaaaacttgcggaccgctccgggggtcgggtccatcggcaccattttgtagcccagctcattactttgtttataaaaaagaaaggcggaaaatgcttgatacgaattatcgcgaacttgagcctcaatcattagattgcttctcatttcagctttcacatcaatttgaggaggattttcaagcaagggtatgtaatgaggcgtctgaaatggttcctgctgaacaacaggaaaagctttcgattcatgatggccgccagacaaaacggaaagaaaagacaataatatagaagcaataaccgtgtatttcctcatcaaagcacctcccttttcatgtattttgcgtctgaacagggaagcttatgagttcatttttgtgcataaagaacaaaaaaacgtctgtctcttgaaaattccactattacctagtaaactaaggatagttaaccagttaacaattaaatcagagaggcaaattgatggacaacagcattcatgatgaattatttcaagctatacaacaattcgcattaaaaagggataaacgcgtctggcaaaaggtgcagataccatccattggcatatcctcacaacatcacgatcacctcaaaaaagactggactttgacccagcttcacattgtttcctgcatacataccagccaaaatgtgaacaacagcttcttagcatcccgtttacacatctcaaaagccgctgtttcaaaagcggttcatgctttgttgaaacacaatatcattacagtgacaaaaaagcctggcaacaaaaaagaaattttttatacgctaactgatagcggcaaagaactggcggggttacatgaacggcttcatcaaaaagcaaaggagcaatacaaacagctcttcaatgaattttcaattgatgagttgaaaacagtgactgcgtttattaacttgtggatcaagcatatgtaaaaaagcctcacccgcacgggagagacctttccatattattaagccctgtcaaatacaatatgaagtgagacgggtccgcgtgtatacagaccggactcagcataacaaaaatcttcctctaatctgatattccgcatcttatccagcacaatattagctacaatttcgatttcggttttggcaaaagctgctcctacacagttatgaatgccggatccgaaagcgagatgccgggcggcgccgctaaaagcgctcttgatgccaagatcttcccgatgaatattaaacacgtcaggctgttcaaatgcttcagggtcccggttagccgcaccgatcatacaaaaaacaatcgtatcttttttgatttccataccgccgaccactgtatcttgggacagctgccgcggaatcagctgaaccggcggtttataacgcaatgtctccgcaatggctctcggaactaacgaacggtcagccaaaacatcattcatctgctcaggattgttgagcaaatggtagatcatcagtgccagcgtcttatcagccggttccgttgcggctaacagcacattaagaatcagtgcgagtatatccttgtccgacatcgccatgccttcatattcagaagtacataggatggaaattaaatctgatcccggattgacgcgacgttcttcaatgaccggcatcaagtattgggaaagctgttcgctgcaccataacgaatgtgcccgcgcttcaggagattgagagatactcgtgataaaatcggcaactccgctatgccactcagagattttttcatggtctcttttatccagcccgagcatgtccatcgtgacgcacaccgcaaacgtctttccaaaatcattgacgagatcaattttccctctttcaagataaggcgctaacaagttttctgcattttgtttaatcaatggagacagatgatccagtgcgtcaccgatgaagcttctcactacaattcttcttttggcagagtgttcttttccatgcatttgggccagcacagggcctcgcattactggttcggcacgctcaacaagtgatttcgtcgtgaaaatatccggatgctgaaggatatagcggacatcatgatagcggctgataaaataactgtctatcgactcttcataatgaaccggatcttcctcccgcagttgtgaaaaataagcatatggattgttttgaaattgatcagaaagcacactaaacaatttaatcgattggctcatgttttactccccctatcatccttcacatgtgatccgtttctcagaaagcatctgcgccatttcctgtacaatgagatacccgtgattcgaccgcatacaaatagaaaattcatggttactgatcttctcaccgagcttccacggacgatgataagcaaggagcgtctcttccacctctaaaatatccggagctccgataaaaaacggcagctcagctatgacatattccacagccaaattcagcatatcctcactgacttcttccatcatcaaactgacgccccgtgcacgcccgattatcgcttcacgagacatgtccaaacaagcatgtcgaaaatgaggctgctcaaaaaaagcatgttcaacttcttgtctcaacagctggtaggctttgttatccataaaatcagaaaatgtatgaatcgccttcggatccccgccatgagccacaagggctctttctgcaaatctcctgtttcgtgatacctctttccttacttttcgttcagcctttcctctcggagttccaagcgcttctagaagattagccgcctcatgccctgcaagtaaaactgaaacgcttttaaattgagctttcgcccatccaattaatctgtaaatataatcctctgaaaacctgctgttaaatgggctgatccccaccaaaacatgcctgcgccgttcaaatatttctctgcagttttctgttaatgcctcagcaataaaatgcacagaccttctttccgttaccattccggtcatctcattcacccctaaaacttatcccgctttaagtcatcaccctcaaatacaagatggaatagctagaacaactgaacaagacgaatggcaggcagcacttaaagtttccaaatgttttttaaaattttaattactatttccatttcacatatcatgataaatgtttactagtaaacattagtcattttatcccttttccttccaaacgtcaatatgatctgtgcccaaatatttgaaaataaatgtaaacatcacattttccacacactttttacacgcatattcagcatgacagatcaacaaatagtctaaacaccaacaattgacaacgaaaacaagaaaagataaaatgaaattgttcaccagtaaacaatttgttttattgtttcatcgtaaactattattactaagaaagaaggtagcctatgtctgatttgacaaaacagatgatatacgacatatacgtgagactgctgcaccttaatgaacaaaaagcgaatacttcacttcagcaattttttaaggaagccgcagaagaggatgtgattgatatccctaaaaacatgacaagcatacatgtcattgactgtatcggccaacatgaacccattaataatgccggaattgccagaaaaatgaacttatcgaaagcgaatgtaacgaaaatcagcacaaaactgatcaaggaagaattcattaacagctatcagctgacagataacaaaaaagaagtttattttaaattaacccgtaaaggcagacggattttcgacttacatgagaaactgcataaaaaaaaggagctggctttttaccaattcctcgattcattttcacaagaagaacaaaaggctgtattgaagtttctagagcagttgacgtcaacacttgaagcagaacaaaccgatgggactccggacaaacctgtaaagtaaacaaaaaggcggtgtacactttggctcatacaaaatcaaaggcagtattgatcttatacactgtttgcttcagtgcattttttgcatctttaagccagaacatttattcacctattcttccgatcattaaagaatcattccatgtttccacagctatggtgaacctgtcagtctcagtttttatgattgtgacagcaataatgcaaattatattaggagcgatcattgattttaaaggcgctcggatcgtcttgattaccggtattctggcaacggcagcagccagcatcggctgtgcggtgactactgactttactttgtttctgatattcagaatgatacaggcagccggttccgcagcactgcctcttattgctgccacaacgatcggacagctgtttacaggcaatgaacgcgggagtgcaatgggaacgtatcaaatgctcctgtctgtcgcaccggctattgccccagttctaggaggattcataggcggagcagccggatacgaagggattttttggatacttgcggccatctctatcgttttgctggtgacaaacagcatcacctttcctaaagattctccaactgaatctatgcagcaagccaaaggcaatgtgttcgctcattataaatcaatatttacaaatcgaacagggaacgtcattttgactttaagttttgttctctttttcatttattttgcagtaattgtctacctcccaatattgctgacagagcattaccatatagatgtgggtatagcaggactgttatatttgccgctggcgctgagcacgattgcaggtacgtttctgtttaaaagaatacaggcaaaaatcgggctgcacaccttgtttatcggaagcaatgtgattgccgcctgcagcatcattttatttgctgttacacattccgtttctctcgttctcatggctctgacgctggcactgtttggcatctcgatgggggttattcctcccttgtactctacaatgattactaatgaatttgagcacaacagagggagtgcaatcggaatgtttaactttatccgatatacaggcatggcagcaggtccgatggtatctgcctacttgctcacaatgatgccgtctgccatgtcctttagcctcctaggccttggatttgccgcattgagcttttgccttcttccgccaatgttttcgccgcagaagcgcacgaaacaaaaaaagcaccacatgtaaaaaagctgcctttgcgggcagctttttttatttttttctaagcggctctaaaatgcctttttgaatcagcaaatggaagaccgacaggataacggatgcccatatcgctgtgccgaagccgtcgatttgaaagctgtcacccataatggacgcggtcatcataagcgtgatggcgttaatcacaaacaagaagagtccaagcgtcaccatggtgaccggcagtgtaaatataattaaaagcggtttaatcagcacgtttaagatcgataaaatgaggctggcgataatcgctgccccaatgctgctgatatggatggagtcaatatatccatcaatgacgattaataacaatgcattgactaaaatgctgactgcccattttaccatgtcatttcatatccctttctgacgggacgataaaaatccaaatgatataaatgagcaaaaccggcaagacacttgtcataatggctaagatgacagttatgactctgaggagtgatgcgtcccaattgaaatattccgcgagacctccgataacaccggcgattttcttatttttttctgagcgataaagcttattcattcgatcacctctgtgagtactttagtttgatggcgcctgttagtgattctgagaagacggtgatgttttgatcatgtgcctgatttgaagtgaacatcatttctttttgaatcgtatcatttttttccttcagcatctctacatccattaattcatgggacagcgtaccaagattgcttttcagctctgccttcactgcgagatcgtccggaattgcaagctctacatttccagtcgttgtttttgcataaatggagcggcagtctgattctgttacgttaatcgcaatatttccgttaaagctttgaacgtcaatggattcgcttttccctcggagatcgatcaatccgttaatggtttccgcttctatcgtaccgcagctgtggcttgcgagcttaatttgcccgttggccgtttcagctatggctttttcggctgttaaatacgagaacgacagcacgccgtttgtcgttttcgctgagaactcttttacatgtaaatgttcccctctgaccggaccgttaaacagcttcacccgaatcttatcatactccttctgaggaatatacaaagtgacattcgttttcatcgtctttttctcagtacggataaaaaacttattacctttgatttcacattcaatatgctgaagaaatgcgtgtctcgccgcatcctggttgtcagcgcgatataccttcgcctggcattccgctctgatatcgtcatcttcccaagggacgatatttacgctgccattggcaatttgcagctcaacactggaaaagtcagtatctttaaattgaaaaatgtgctgaacatcatacgcatggccaaagtttaaatcaaggtcaacttccttgacctttttcacagcagaatcaatccagtcaaacagcttggctcctaaagacggtttaccgctttctttttttgccgttgtaaatggctcttcctcgtcatgaacgtgaactgagagcgctgtgattttctcttctttttccttgtagtcgctgtcaagcttttcaatcagtgtcaaagcttcttgtgctgtaagctttccttcctcaacaagcttaaggattcgttccttttcttgcttcattacgatctcctccccattgtctacttatgctgcacgcaggaccttaatgccctgaatcacattccaaatgataatgccaatgacaactaagaaataaataaccgctcccccgatgattacaaatacaggaagcaagctgtctccatcaatcgcaacggctccgccaagtaaagcaataaaaaggaacagccagccgacaaacggaacaatgtgagaaataagagagcgtatcgcatggcgttttgtttctttctcatttacaacaaaatatgcgacaatcggcacaatgattggcgcaatgaacacactgaaataacaaagtgatgcaataatagcttgattacggttcaattcattccacactcctattgtgaattgtccatgacaaaagatcagggacgttttacttatttatacgtttaaaatctcttcaggtttcaaattcattctttagacatgctccgatttacggaaattggattttaaaaagttttagaagtagaatcttccggctataccgattacaatatgtaaaaagcttacggcaaccaaggaggctggacaagcaatggagaaagatcccagtgactatacagtaacacaagaatcagtgttaaagctgattcaggaacaaaaaagaatgaatcgtgaaatgatcaccgagcttgagcagattcacggacccttcccgatctctcacgatatccaatatataaaagtgctgctcgacagcagcaacacacatattgttcaagatttaatgagtgtaagtaagcagctgtataagaagactttgtaattgcggaaaacatatcattcattataactgaaacaaagctaaaggttagatgacaatatcttgccttttttgttttgaaaaaacaagtgattccctggctgtcacaaaatgattgtaacaaaaaaaagcctgccggcacatccagttaatggactctgtcggcaagctgtaactatcagaaagagatagccgttcaaaattaacgtaacaattgaagcacgttttgcggctgttggtttgcttgagcaagcatcgcttgagaagcttgagaaagaatgttgttctttgtgaaatcgctcatttctttcgccatgtcaacgtcacggatgcgagactcagcagctgttaagttttcagaagaagcaccaaggttgttgattgtgtgctctagacggttttgtaccgcaccaagtttagcacgttggtttgaaacacttgtaattgcactatcgattttaacaatctcagtgtcaaaactaaaatcatctgctgaaacatcgataccttttactcctaaagttgttgcatccatgttaccaattgtaacattaatattttggccagcatttgcaccaatttggaatgtaaatcctgctgtttcactaccgtctaaaagtttttttccgttaaattcagtacgttgagaaattccatcgatctcttcagttaaagcatccatttcatctttaattgcagttaaatcttcagtttgctgtgtacctgtgtttcctgcttgaacagtaagttcacgcatacgttgaaggattgcatgggtttcagtcaatgcaccctcagctgtttggataagagaaattccgtcttgagagtttttagaagccatttcaagacctctgatttgtcctctcattttttcagagatcgctagacccgcagcgtcatctcccgcacggttgatgcgaagacctgaagaaagtttctccatgttttttgagctcgcactgttgtttgaagacaaacggtttagtgtgttaagcgctgcaatattgtggttgattctcatgtgaaaaatacctccatgtgtatatgtttttgaaatcaaagacttccttttctttgatttctggcgtatcagattccaataaagcttctaacctatgtagattcagttattgcttaaggatgcctttaagccccttaatagggtttgtctgcttaatttggaaatcatcatccgcctttcaattcatatatcgacagccatttgtaaatgtttaggcgttttcccaaagaaattataccaaagacgaatctaaacctattatgccgtaaagaaaaagcttgcctgctaagcccaaggatggacttgctgacaagctgtcccctcttaacagaggtttttttaagatgtagctgtttcttttgctttcaagagcgatttcatgcgtgttttgtcacgttcgataacaggcttcaaataacggcctgtatacgattcttccacttcagtgatttcctcaggcgttcctgacgcgacaatggttccgcccccggctccgccttccggtcccaaatccacaatgtaatcggccgtcttaatgatatcaaggttgtgctcaataaccagtacagtgtctccgttgtctaccaaccgttgcagcacgacaagaagcctggcgatatcgtcgacatgcaaacctgtcgtcggctcatctaaaatgtagagcgtgcgtccggttgagcgtttgtgcagctctgacgcgagcttcacgcgctgcgcttctccgcctgacaaggtcgtcgccggctggccgagcgtaatataacctaaaccaacatcataaagggtttggagcttgcgtttgattttcgggatattttcaaagaaagaaagagcatcttcaaccgtcatatcaagcacatcagagatgctttttcctttgtacgtcacttcaagcgtttcacggttatagcgtttgccgtgacacacctcgcatggaacgtatacgtcaggaaggaagtgcatttcaattttaataatcccgtctccgcggcaggcttcacatcgtccgcccttcacgttgaagctgaaacggccttttttatagccgcggaccttcgcttcatttgtctgcgcgaatacatcacgaatgtcatcaaatacaccggtgtatgtcgcagggttggatctcggcgttcttccgattggcgcctggtcaatgtcaatgactttatctaaatgatccaaacctttaatctctttatggctgccgggcttcgctttcgctttatgaagcttttgcgccagcgccttatgcaaaatttcattaacgagtgtactctttcctgaaccggaaacacctgtaactgctgtaaacgtcccaagcgggaacttggcattcacttttttcaggttgttttctgaagcacctttaatttcaatgtaacgtccgtccggctttcttctttcaggaggtaatgggataaactttttccctgataaatagctgcccgttaatgagtttggatcttccatcacttcttccggtgtacccgcagatatcacctgtccgccgtgaatgccggctcccggtccaatatctattaaataatctgctgccatcatcgtgtcctcatcatgttcgacaacaatcagcgtgttcccgagttctctcatatttttcagagcgctgatcaagcggtcgttatcacgctgatgcagaccgatagacggctcatctaaaatataaagcacaccggataagcgcgagccaatttgagtcgccagcctgatgcgctgcgcctctcccccggacaatgtacccgctgccctgctcaatgtcaggtaatcgaggccgactttgtccagaaagcttaagcgctccacaatttcgcgcaaaatcaaattggcgatctgcatatccttctcagaaagggtaaggtctttaaagaaggcaagtgcgtcggcgacagacagctcggtaatttttccaatgtggcggccgtcaatcagtacggcaagcgcctctttctttaaccgatagcctttgcacgtcggacaagatttctgagacatatactgctccatttgctcacggatgaaatcagagcctgtctccttatagcgtctttcaatgttgcgcaatacgccttcaaattgaatttcaccttcgcgtatttgtccaaaatcattttcatatcggaaataaatcaggtcatccccgctgccgtacagcactttatccagttgatgcttcggcaaatctttgaccggcacatccatatcaatcccgtagtgggtgcagactgcctcaagcagctgaggataatattgtgagctgatcggtgtccaaggggcgaccgcattctccttcaatgacaaatcttgattggggatgacaagatcggcatccacttcaagcttcattccgagaccgtcacacgtcggacacgccccgaacggactgttaaacgaaaacagacgcggctcaagttcaccaattgaaaatccgcagtgcggacaggcataatgctcgctgaacatcagctcttcctcaccgatgacatcgatcataacccgtccttcacctaaacgaagcgccgtttccaatgaatctgacagccgggctgccacgccttctttcacgacaatccggtcaatgactacctcaatggaatgcttcttgttcttttctaattcgatatcgtcggaaagctcagccatctcgccgtcaattctgactctgacatagccttgtttcctaatctgttcaagcactttgacatgagcgccttttcggcccgagacaatcggcgccagcacctgaagcttcgttcgttccgggtattccagaattctgtccaccatttgctcgatggtctgggatgtaatctcaattccgtgttccggacaatgaggcttccctactctcgcatataaaagacgcagataatcataaatctcagttaccgtaccgacagtagacctcggattgcggctcgttgttttctgatcaatgctgatggcgggagagagccctcaattgcatccacatcaggcttatccatttgccctaaaaactggcgggcataagcagacagcgactcgacataccgtctctgtccttcagcatatatcgtgtcaaaggcaagggaggatttacctgatccggacaaacccgtgacaacgacaagctgatctctcggaatcgttacatctatatttttcaggttatgcgccctggctcccttcacctctatccgatccatagccatttgttcatcatccttccgcttttagctctaaaagtaaatcgcgaagctccgcggctctctcaaagtcaagcgccttggcggcttccttcatttcatgctccatctgttcaacgactttctggcgttctttcttcgtcattttcgacagcttcggcgcggcttttgttttgtattccgctttatcctcagctgctactgtggcacgaatgacatcgcgaatttctttatttatcgttttcggcgtaatgccgtgctcttcgttaaaccgctcctgctgctcgcggcggcgttttgtttcattaatcgcaatttccatagacttcgttattttatcggcgtacataatgacgcggccttccgcatttctcgctgcccgtccgatggtctggatcagcgaccgctctgaacgaaggaaaccttccttatccgcatccaaaatcgcaacaagggatacttcgggaatgtccaaaccttccctcagcaggttgatgccgacaagcacatcgtacttgccaaggcgcaggtcgcggataatttcaatccgttcaagcgtcttgatctcagaatgcagatagtttactttaatgccgatttcttttaaataatcggtcagatcctctgacatcttcttcgtcaaagttgtcacaagcacccgttcattccgctcgattctagcttgaatttcgccgatcaagtcgtcaatctgaccttcgattggacggacgtcaataagcgggtcaagaagccccgtcggacgaatgatctgttcgaccatttcatctgtatgttcaatctcgtacggccctggtgttgctgatacatacacgatattgtgcatatgcttttcaaattcctcaaaacgaagcggacggttatcaagcgctgatggaagccggaagccgtgatccacgagcacctgtttccgcgcctggtctccgttaaacatgccgcgcacctgaggaattgtcacatgcgactcatccaccacgatcataaaatcgtctgggaaataatcaagaagcgtatacggcgttgaacctggaggccgcagcgtcaaatgtcttgaatagttctcgatgccggagcagaaacccatttcacgcatcatttcaagatcatatcttgtccgctgctctaaacgctgcgcttcaaggagctttccgttttcatgcatgaccttcagctgctcctcaagctccttctcgatattttgaatcgccttctccattttctcggcccgcgttacgaagtgggatgccgggaaaatcgcaacatgatctcggtcgccgagaatttctcctgtcagcgcatccacttcccgaatccgttcgatttcgtcaccgaaaaattcaactctgatacaatgctcatcacgggatgccggaaagatttccactacatccccgcgcacacgaaatgtaccgcgctgaaagtcgatatcgttgcgggcatattggatgtctacaagttttctgagcagctcgttgcgctcaatttccatttcagtccgcagtgacacgaccatttcccggtattcctcaggcgaaccgaggccgtatatacaagacacactcgcaataataatgacatctctgcgctcaaacaaagctgatgtggcggagtgtctcagtttatcaatttcatcattaatactagcgtctttctctataaatgtatccgtttgaggcacatacgcctccggctgataataatcatagtagctgacaaaatactcgacagcattgttcggaaaaaattccttgaactcactgtaaagctgtccagcaagggttttgttatgggcaatcacgagagtcggcttattgacttctttaatcaaattagacaccgtaaatgttttcccagttcctgtcgcacccagcagagtctgatgcttcttgccctcctgaattccttttacaagcttttcaatggctttcggctgatctccttggggctgatatttcgagactaactcaaagcgatctttcacaaaaataagcctccgtttctttaacgaaatcttcctatagatatagtaacacaatggaaagcaaaatcactaaaaatacgaactaaagttcggtggttttttatttccagctgtttttgtgtataaaaaacctgcttttaaaacgtaaaagcaggtattcagtctttatattcattatgtccgatttattcttcttttttctctgcagcttttttggccatatacagtccgccagccacaagagacacaacatccaatcctacaataaaatacgtttctgtatagccttttaaataagaggcaaacagcaatgcagctgttaaagcgatcgccacataatgattaaaggtgactctagtaaatagaacaacaagcataaaagggaaaaacaatgcaaaaacggcttttgtaatcaacaaaaaccctcctcagggattcttcatctgatctgattatagtaaaaaatgaagaatcggacaatcgtgcattcgctccctctactacaccataccccttttcagccaaaatcaatcactatatttgcattttggtgccggtcaaaacttattccatggtgccgctgttctaatcagcggcactttttttattacatcatcaagtccgccgccagattccgagaataaaagaaaataggcatacagtaccagtacggccgcatttttcaggataatataaccaacttaactattcattttatttaggactttctgcgtttgacagcattttcctgaaaacctacaattaaatgatagtgtttactatcattttttaaacacaggctccgcaataaaaagactagagagaaaaacaaaatgaatgaagaaaagaggggtttcaaatatgtattctgttttatttcgccaggcagaagagtccagccagctggctggagcaaaaggaatgaatttgattaaattgaccaaacacggtcttcctgttccggacgggtttattattcaaacgaatgcgatcgcacgttttatggaggacaaccagcttcaagagactagtgaaaacgtcgaaggcgggatcatttccggaacattttcggatgagctgaaagatgagctgactagttccttttataagcttagagaatcatatcgatccgtagccgtgcgttcttcgtctgcctcggaagatttagaaggcgcctcattcgcgggtcaatatgaaacctacttaaatatcaaaacagaggaagaatttctggctaaagtgaaagaatgctgggcttcatttttttctgggcgggtcagcagctataagaaaaaaatgaacaatcaaatcgcagagccgttaatgggtatagtcgttcaggggctgatcgattcagaaatgtcaggtgttatcttcagccgcaatcctgttacccatgatgatagagagcttttaatcagcgccagctacgggttgggtgaagctgttgtttcaggaagtgttaccccagacacgttcattgttaaaaaatcttcgtttgagattcaaaaagaaataggtgcaaaggaaatctacatggagtctgcggcagaaggaattgctgaaaaagaaacgagtgaagacatgcgcagccgtttttgccttacagatgaacaagtgattgaattggctgaaatcacaaaaaaaaccgaagacctgtacggatatcctgtcgatatagaatttggaattgctgatcatcaaatataccttctgcaagctcgtccgattacaaccattgatcaggacaaaaaggcggcagaagaaaaacgcagcttcatgattaccgacactgatatgaatgatttctggcttaacatggagtctaatattgaaggtccggtgagtccgttattttcatccttcatcgtgcctgcgttggaatatggcttgaagaagagcatgcaaaagtttccgattggtgtagttgttgatgaagtaaaactttatcgcggacatatttattccaaaaaccaaggagggcagcagcctccttctgaagactgcggcaaagagcttttcccgattttatcggagcatatgtatgacatcattaatcacacatacctccctttttaccggacactggaccagctcgcacaaactgagcataccgcagaaagcgcactggatgcttttcaaaaactaaaggccttttatctcacggcttatgaagagcacttcaatatcgttttcccgcaaatccttttaacaaacaaactgcaagcgatgtatcaggacattcaaggagagtccgaaaacgctcatttttacgagatgctgacaggaaaaatgaacaaatcactggaaacggaccgttgcttatggctattttctgtggaagttcaggagaacccgaaccttctggccatttttgaaaacaacaagcctgaacaactccaggagaaattggaacaaacagatgagggaagacacttcctgaagaacgtccatgaattcttgcaagaatacggatggagatctgttaaaagtcatgatctgattgaacaaatctgggtggaaaatccgtatttcgctctggccaatattcaaaattatgtccgtaatggctatcattttgacaatgaatttcagaaaacgaaagaaaaacgagagaaattatacaatgaattcttggaaaacatagaagatcccggtttacgcaccgaatttgaccgctattatcaatggacactgaactctgcaaatataaaagatgatcaccacttttatattgacgccatgctggatgccaaggcgagaatctttctgctgaagataggtgaattgctggcggaaaacggtgtcattcaagatcgtgaggacctttggttcttatatgatgacgaagtggaacaagcgcttcttcaccctgtatccctgcaagaaaaggctgaaaaacgcagacagatttttcatgagtatgagctggcccaagccccggcctacctcggcaccccgacaaaagaacagctcaaagcagctgaagaaattgtcggcgctgtgatagaggatgaaaaaaacacagagaatcatatttttggcattgcggcatcaagcggcattgcgacaggtccggtgaaaatcattcgggacgccaatgaattttctcaattcgcgcctggggacgtactcgtttgcaagatgaccacaccgctatggaccagcctgtttcaagacgccaaagcgataattacagacacaggcggcattttgtctcacgctgcgattattgcccgtgaatacggcattccagccgttctcggcacacgcacggcaaccgaaagactgcgagacggtgacatcatcactgttgacggtagcagcggcaaaatcacagttgtcagccggtcctgatgcgtccccctctttcttatacaagcggggcgggtgtatacttgtcctgccagtatactcgtgaggtgaaacgtattgagaccgacaaacaagagaatccttgatgctgccatgcagctgctcgtcaaaaaaggatatcgcgcaacaactacaaaagaaattgcagaaaaagcaaatgtaagtgaagcgacgattttcaggaactttaaaaacaaacaaggactagttgaggctttgctttctcagcattcttcaaacagaggcagcattttggaacaaacagaaggggatttgtacaaagacctgcttcatatcggaacctgtctcttggaggagctcgaacatagaaaagatatcattaaaatcagctttcgtgaaccggccatgtttcaggatgtcattaaccacgtcactgaatatccccaatctatgaaacagctattggttgattatctcaaaacaatgggtgagaaaggggttattcagacaggaaatgaagcggagcatgccgacgtgttcatgtcgattatcttcggttatttcattcaccgtctccacttaggagaccgggtcatatcaatgccccaggaaaaaatgctggagcacagcacagctctatttgtcaaaggaatttctgctgattaactccttggcataataaaaaggaggatcccaatgagctcaagaaaagaatgggcgctgatcgtctcgctattattgggggccattctggttcccattaactcaacgatgatcgcggtcgcgctctcatctatttcccatacgtataacgagtccatcgcaagcatcacttgggtggttaccgtttatttaatcgtgatggcagtcacacagccgattgcaggaaagctcggtgacatgtacggcaataaaacaatgtacttatggggagtcggcctttttctaatcgcatctctaggctgcgccctttcaccgagtctgctcctgttaattgtctttcgggcattgcaggctgtcggcggggcattgcttacgccaaacagcattgccattatccggcatgttgtttctgaaaaacgcctaccgaaagtgtttggatttttcggactgggtgcgggacttggtgcagcactcgggccttttatcggctctatactgattgacagcttcagctggcattcgattttttgggtcaacatcccgttcctcgccattgctttatttacggcattaacgatgtttcctcaatataaagaaaataaatctgacgcgccgctggatatcatcggctctctcttgcttgcaggcagcatcgtttccattatcctgctgacgaaaaatgaggctccatggggatatgcggtatacagtgtattgatacttctttttgttccgctttttttcagaagagaaatacgtacccagcaccccatcattgactttgcactgtttaaaagctcaacctttacaaatgcgaatctatcagtcttgttaagcaatttgatgatgtatgccgtcttattgattatgccgttatttatgacgaaccaatttgggcttaatacgtctaacagcgggatggcgctttctgtattttcgatcttcatgtcagccagcaactgggtgggcgcgcagctccatcacaaatggggagccaaaaaaatcatttttctttcatttgccatgatggctggtgcgaatctattatttttgctgttaagcagctcgcattctgtcttattcctcatgctctctcttatccttggcgggctcgcttccggagtcggtctgaccagcatgcaggtgtcatcccttgccacagtagaccccggaatgtcaggagtggcatccgggattttctcgaccttccgttatttcggaagcatcatttcatcagccttaattggcctgatttcgggatatcacatcctatttatgattctctttgctgtatccatcatcggcgtttttgtttcattgggcatcaaatctgatgaaacggcacggatagaaaaaaactcagcgtaacgcaaaacagcccggcatcgcatcttcctgcggtgccgggctgccttttatgatccagaagcggctgcttcgtcttcacggtcatcctttacgaagaggatgcccaattcatgatgttctccttcataagaagctcgctggtcaaaacggatttctccattcaaaccgataatttcaagctttacatatgcacggttatgctgaagcgcttcatagaaatcagaaacgttcttaaccggtatgccattgactttcgttatgatttccccgattttcaattccagatcctcagccggcgtattggggataatcccaagcaccattaagccctgatcccttttcgagaaataaaacggagccgcgttatcattcactctttgctttatggacaaaaaaatgcgccctaacaaagcagtacagaccgctgcacccgcaagcggcgtccacagtaagctcgctgcaccgagaactgcgacggcaagaccgagaatacaaacgcgtttcgctgtgatccttatactcgtttcaggcagcgatccctgtaccctttgtccaaatccgacaaagtaaggaatccatagaaaatgaaatgagccgccgggaacagtaaacacgggccaccagctaaggtgcgattctaaaccattgccgggcacgagaaggaacagcggcaaaagccaaacccggtttgccagctgctgtccgatcggcaaaccgcggctgcttacgacaagtgccggtgatgttctcacatgcgcagaacgataagcaaccgctccttcagtgataatcagcaaacctagaaacacagccacagccggccaaacaactgcaaatccttgctgaaatctctccagaaagggctccgcctgatatatttgcagtccaaaacctatcagcatactcacactgacgatatatgcagcagacatccagtttgcgcgaagagtgaacgctgccgctgcagtgataacggcaataatcgcaagtaaaccgagaggaatcgatattccgagtccacctaaaataactgacaaaagaagacctggaatcagtccctttgtatatgtaaatttcagatcatcataaatatctgctattcttgtatgaaaggtttttcgttcccgtttgattcttacatagccgaaagccagggttatgatgataaaaaaccagaaaagcgggtgtaagaagaacaagcccgcgctttttaacagttcaattccccattgaacagacactatctctcaccgcctcaagccaaacatgttactcatattctatcaaatattaaatggcttggatatcctcaggagagtttatctctcttgcgtcatccacagcgtgacattcgatagtgaaaaatcctttaaatagtggtttacatccacatccaataacccgctgattagatgcatcgacctttttatatctgtcagattaattcctaatcgcttatggtttttcattaagtagttaaaataatgtttggcgcattcctcattaatgtcatttactgattcgacattggtgtaattgaccaaatatctgctgaacagcataagaagacttagtgcttttgtagctgaaaatgttacgtcttgtgttctgtcttttaattgttccactaattcataatattttttttcacgcacaatacttgccctcttcaattgtgaacccccattttctttatacagataagcacgggccagtataagcagcagtactggagtgctaacaagcattctcgctaacgttactctttaaatacctgtcgttcagctgccattaacctgattactgttctttttagaaccttcttatattgtatgaagtaaacaaagactaggcaacttgcaaaagtttcattttaaatgcatattaactcgttagaaagtctctctcatatattgatatcgggtaataacagtcctttataaatgtttatttgtgaaaatttttttaatttcttgtcaaaaactcattttttatgtgacttatgatccataatctctttaagtacaaagaaacaggagatggaataccatctcctttaattgacaaataatgatttcaatgctgtttgaagctgcaaatcatttttgtcatctgattttttcttttctatctgctgatttaatgtctctgcagtgcgagtgtcgatcacaccggttttattcagcttgttttgatcctgaaaagccataaccgcttttttcatgtctttgctgaaatagccatcctcacgtcccggatcaaagctgagaccttttaacaatacctgcgcatgcttgacgtcttcattgttcatgtccactttaagcggctctttcagctgtaaaggcccagcggaaaaataatcgggctgcttaatcgcaatggtcggttcaattcctttcttatgaatccaatttccatttggcgtcagccacttgtaaagcgttaatttgatgttgctgccgtcccccattggcacagcctgttgaaccgttccctttccaaaagacgtatcgcctacaacatcataatggccagcttcctttaatgcgccggcaagaatttctgatgcagaggcacttcctttatccgtaatcacattgacagggtacgcttttttatgggtcaatgttgaaaaataacgttttttatccccattgcgttcagcaatctgaatatacggctgatcctttgtaacgaaatgcttaagaatttcttccacactttgaagatatccgcccgggttgccgcgtacatcaatgacaagtccttttatttcttttttctcaagctccctcagcgcttttgcaaaatcctctgcggtgtgctcagaaaaagtagagatggcaatatatccgacagaatgcccctgtacttttttctctgatgcaaaaaccgtttcgagcggaatctcagctctcttgatccggaatgacagctgcttcttcgttccaggccgctgaatcttcattgaaacgctggaccctttttttcctcttatttttaacacagcgtggtttaaatccttgccggccatcgattctccattgatgctgataatttcatcattaggcttcaacccggctttttccgctggcgatttcttgaatggagaaacaataataattttgccgtcttccattccaacctcagccccgatgccttcaaatgaggaatcaagagaatcagaaaattgcttagctgtctgcttgtccatgtaaacagaataaggatcatttagcgtagacagcattccctggatggctccctcgagcagcttttctctatctactttttctacgtactcattcgatattaactcatacgctttttcgattttgtccatagctttatcccgttcagagtcagcttgtgccgtcgcgggaactgctgcagtctggggcttatccatctcaagcaggttgattcccgcatatacaccgacgcctccgaacagcatgctccctgctgctatcacagccattattttttgattcatcctttactcctcctgtatgccagactgtctttaccaaaacctagagatagtatatgtaaaggatggagatttcatgtaatcatagaagaaaaagaaggcaaatgaaaagccgtcccgaaaacggaacggctttttcactttatactcgcaaaaacttgcggatggaagtcagacttccccatactccaattactgcgccgattgcaatcagcactagcgaaacttggaatacaaatggattataaggaagaagagagacaaatgatccttgaacctttggaacgacccatccgatgacgtattggtaagtgctcagcaccagtgcaatcggaatcacagaaccgaatacgcctagcagcaatccttcaaggaaaaacggccagcggataaaccagtttgtcgcgccgacaagcttcatgatttcaatttcttttcttcttgcgaaaattgtaattttaatggtgttggaaattaagaacatcgccgtaaataccaggccgataattaacgcgattccgatgttgcgggaaacgccgaccactttaaacaaacggctgacctcttcttttccataagtgactttataaacatgatccattttttcgatctttttcgccacgttcggcgtatcatgcggatctgtcgttttgacgacaaacgcatcattaagcgggttttcctgatccttcattgtcagggattttccgctgtcaccaaaactgtcaaccagctggtcaagctctttttctttagatgaaaaagtgacactctgaatgcccttcagttccttaatatcgttctgaagcttgtcctgtgccttctgatctgcagtcagatcaaccagcactttgatttcgacttgtttttctgctttcgtggccatgttattcaaattcagcataatcactaaaaacacgccgactaaaatcagcgtaacggttacagcactaatggatgcaaatgtcatccatgtgtttctcccgagagatttaaaactctcacgcaagtggcgcccgagaattttaatcatatgaaccatactcccctcttgactcatcacgcacaatgataccatcttcgattgcaatgacacgtttcttcatggtgtttacgatttctttattatgtgtcgccatcacgactgttgtcccgcggttattaacttcctccagcgtcttcatgacttcccaggacgtatccggatcaaggtttcctgtcggttcatcagcaatgacaacatcagggttgttcacaattgatctggcaatagatacacgctgctgctccccgcctgaaagctggtcaggaaattgtcgcgctttatgcttcagctgcacgagatcaagcacttcaagcacccgtttcttaataacagacggctgttctccaatcacttcaagggcaaatgccacattttcaaaaacagtaagtttcggaagaagcttgaaatcctgaaagacaacgcctattttgcggcgcacgaaaggaatctctttttctttaattgtcgcgagatctttatgattgattaaaatttgtccttttgtcggtttttcttctctgtaaatcattttaataaaagtagatttacccgctccgctcggcccaacaacatacacaaactcaccgggatgaatggtaacagaaatcccattgagcgcttttacgccgttcggataggctttatatacttccttcatctctatcatgaaatcacctaatcttttatatcattttatctatcacacggtcatactcttcgaatgcattcgacaatttatgatccattcatttgtaaaaagatgaaaaatctgaaagttccctttttcaatacacttcattatacgtcaaatttagacataatactattacagtttcttttcattcatatttaaagaataaatattcatttgggttggaagtttcgtttattacgaaaactgtttttccatttaaatgaatcaaatccactacttgacaatcattgataaataatataaaatttcgtcaaaattacttttttgtatattaatgttaatatatccataaaaatgaacttggtatcactctcaacttgttatctcatatttacataatctaagtagacacgaactaacagaaaaacatcattaatttatttaaggggtgttataattgaagctaatttacaaggacgaatacggtcctctatattctgaaaagtcaaagaattctatccttaaagagcctacttattttgaagttgattccaaagacaacttaaatagaattgttgataaaaaaggacattacacttatcaaaacaataagcttcataagataaaacctaaaaatataggtgcatctggcagtaatagtggataccctctcattatggataaaaaaggacactccttggaatatggtagagaccttcttgaagtatcaatgagaaataaactttatattaggaccacagaaaaagaatattgttatgagtacgataccgaagttgaaccagatactattcaaatttttgatgacaaagtgcttttgaatttaaaattaagacaaatggttgtacttgtatctacttcaggtaaagttttaaatagctttggtcttgatagatacagaggtgaaggacaaaaacaattaaatgttcccatgttctctgtatatatagaagatagaaattctatattaatttcagatgccattaattcaagagtaattgaagtcgacgaaaatggaaatataatttggaaatatggaaaggatggtttattaggttcggatcaaggactcttatggaaaccaacttgcgcaagaagactttccaatgggcatactattattgcagattccaaaaataaccgattagttactatagatcaagataaaaatattgtaaatgagattgggcaaacaaatgtttctaaattgtttctcacatatcctcgctctgttcaaatgcttgataaatataattggctggtgacaaatacacacaagaattctatctttatcatgaatcaaaatcaaaagaaaatcataaaacccataaatgattcttataacaagttaaatttattttggccaagatgtagtataaaaaactcggatgatgaaataatcatagcggacggaaagaataatagaataatgtttattgacgataaaacattacaaataaaaaaagtaattgattactattatgaacaaggtaatagaatgacaattattgatcctcatgatattaaaataaaccctaaaacaaaccttcttctcattaccttatctggaaacaatagggttatagaaatgactagtgatggcgagttaattgagagctatgataatctaaacgaccctcattctgcttattacttttcaaatgggattattattgctaatacggaagacaacaacatagttatttattatttttccggcaaaaaagaaatcattaataattttaaatctactaattcatgctgtgatgcctttaagagacctcgttatgcgctaccttataaaaatggatttctaatattagatacagacaatcaaagaattatatttttaaaaaaagagaataacgaatggattggagaaaatgtgcctatctattttcctgatggacctataatgaattatctttgttttcctcggtgcattacatttaacaatgataatgaactaatcttaaccgatactgaaaattgtaggattttacgccttgtgattgacgacactcttattaaggaggagcattcaaatgaaatataaagttgattcggcacatggtggtgaaggttgggtacctagaaagcaagatcactctacagaactaggtcatttctggaataactgtggcgtaaagggcgaattcggtaccctgtcacatgttttacttagaagtccaggtctagaggtagaacaaaattttaatcctgctgatatcctatggactgagagaatagaaccatcgaaagcaagagaacagcataataatcttattgaagtttatcgctcccaaggggtagaagtagacttaattgatgataaagcagctgaatcttttccaaatattttgtatgtcagagatttgtttacaatgacagatcaaggagcaatcctatccaggatggcatcagaggttagggctggagaagaagtaattatttctaaaaaactatctgaactcggtatacctattttagcctctcttcactcggatatgatattagaaggtccagacatattaatagtcaatcctgatctagtatttataggttatggtataagaacaaattataaagcagctatgtatgtcaaacagatactattaggattgggatattccgaagttatcatcattcaaactacttatggctgcggacacttggatggtgtagtgaatattttaaattctcggtatgctgccattgttccaaaaagagtttcatatgagttgtacataggattaaagaggcatgggttttcaattattgaacttgacgacatgtatgaaatagatcagttgatgtcaattaatttcgttcagctaaacgaagagactcttctgattaataagggtgccaaaaatacagtgtctcaatatagctcatgtggctttgaatgtctagaaatagacattagtgaattaacaaaaggaggcggctcaattcattgtttaacagggattttaaggaggatttaacgagatgggcgtttctatagtaattccaattaaagttaactcaatcgatgaaatatatattgatttcatcaattacatcattgatttttcttccaatgtattaactaaagacgttgaaataataatagccaatggaagttctaaaaatatttatatatttgctaatgaacatcttaaacatttgaaaaatgttatacattttatcccacatcgttcaattagaacaggagacaacgataaactaaacgggatatactctgctttaatgtacactaagcatgataacattttattagttgatgatcactatagagtatcaagtgaaacgcttgcagatatattaaaatactatgaaaaatatgattgttttaagtttatgcctaaactacatcaatacccacattcagctttaattgatacatgtggaatgtttattgttaatgtattagatagtagaaagcaatattgcggccatttagcctttaaaaaaagtttatatagtgaatggggatttatcaatagagattctctatttgatgagtttgctatggaaaaacatttacgaaaaaagggaagcagagtcggatttataaaagatatcgctctggaagccaaacaagaaattccgtttaaaaaatttcttgagcagagagtacgttatgcttatgaaaacattgctactccctatcgctttacctttttcgccatgatcttaccacttttaatactgttaagcctgatagacacgaactatggtctgaattttgcattttttctaacaagctggacctttgtcatatcaatagtaggtcaattcatttatggtaaacaaatcaccccttggtacacttcactatatagtcctatttggttctggttttatccttttactacgtggatagcaatttacaagtaccttaccggaggaatcatgtttggcgggaataatattaggagggcaggatagatgaaaatcactcaaaagattatagggccacaaagtattgtatacttcaaaaaagataaaaatagagaatttgttgaaaaaatttccactgaacgaggagaagatgaattagttgatcaaattcacttttataaaatgttaccaaaagagattaagcctctttttccagccctatatgattatgatattaaaaacaggccgtttcgcatgtcaatggaattatgtgattttccaacattaaaagagattattttatacaatactaagcaaaacaagttgaaggaacacttatataatgttatacaggacatatttgaaaaaatacacaacttaaaacaaacacaggcaacaaaaaattatgtagaacatttgtatatagatcgttgcgtcaatagaataatagaaacaaagaaattaatgaaagaagcacaatggataaacaacgacttttacttagagggttcaattgtatccaacccaattcaaacggtttttgaaattataaataataataaggatttattaatacctgaatatctatgcactgtacatggacagctaggtccttctcacttaatgttaaacattcaaaagaagaatagttacaaactagttgatccaaagggatttcatgaatttcatgatccattgttggatattataaaaataggtaggtccttcctctatgggatggagtggttagaagatgacttgtataatattaaatattcttttaaaaatgaatatcttacaatagaagattttaatttaattaactatgatgaagtatatatgaagaagtcatttaaacctataatggatttagccataaataattacaaaaatgctgccctaagagtatatgccttaatttgctgtgatctaatagcaaatttaccttttgcatatttatcaggtggtgaaaagagagtagtagctttatataatctcatatatgctgctagtttagatttgtctcaattaaatgatgctgtaaataaggagaaacatatatatgaaagtctttcaaaataacagatataatatatttaattacaaggaaagttctatctttatagaagatagacaaccccattctgttcttacaatagcaaatttaaaaaatcaattagttgtggtgagacaaatgcgaaaaggaataaataatgaaaccgtcgaattgcccgggggacaggttgaagataatgaaaaacctatggacgcagcaaaaagagagctagaggaagaaactggactaatagcaaatcaatttattcaaataggtaatatttatcctctccctagtttaattaatcgccaaatcacatatttttatactgaaaatattgttggttataataagactattaaacaggatgaagatgaaaatatacatgtagaatatcacaaatttccaaaagtcgagtataatcttaaaacccaaaagtggagggatcaatttcttgcttatggagtatatatctgcaaattgaaaggaataatataaaaattttagaggttaaaaatggatgtccaatctatattatttgatcttgataacactttgttaaatagacaaaaaacttttgaaaattatttagattcatttatctccaagtatattttctataactccccgaccgaaaagaaagatataaaaaataaaataatagatatggataaaaagggagaaaaagataaaaaggaattgttttcagaattacaacatagattaaagtggagattaaccccttccgttgattatttagttgaagaatataaaacaatattcgcaaaaaacagtatagttatggatggaacttttgaggttctaacattttgcaagaataaaaatttaaaattagggattataactaatggagaatcattttatcagaagattaaactaaataacacaaaccttacatgtttttttgattttatcttaatctcagaggaattcggtaaagctaagcctcatcgctctatctttaaattcgctattgataagatggccattgatccacgaaaatcaattttcattggagacaatcttatttctgatatttatggtgcttctaggtttggattttatactgtttggtataatcactctaatatagtcaaacaaaatcccataactgtaaaacctaataaaattataactagtttaagtgaattgttgaaaataaaagactggtagccgaaaggagaaaaaagtgattattagtgttgattttctaaatcatttacacagtatttataataaaaataacgatctatccgaaaatgttaaaagaatattcaaagaatataaatgcagtaatatttatgaacacagtgtaagggtagcacatatggcaaaaaaattagctgtacggtttcgagccaatgaagaatcagcatatatagcagccttattacatgatattggaggtattgttcctaatggaaaaagaattgaaattgccaatatactaaaaatccctctttttcctgaagagatagagttcccactaattattcatcaaaaaatctctaaggttattgctgaaaaagtttttttaataagtgaccattctattcttaatgcgatagaatgtcatacaactttaaagtcgaaccctagtatgttggataaaattgtatttatatcagacaaaattgaatgggatcaaaagggttctcctccttacataaatagtctaatagaagccttagatgtttcaattgattgtgcttcaaatgtctatattaagtttcttatggaaaataaaaataatctaaaggttattcacccttggcttagtgactcttataactattttaaaaaataaccctcaactcaatactatatataatattatgtatttaaatccatcaaagttgtgtaaatattggcaagattctcttaagatagccttgtattttttgtttaacactcttagacctaggattaataactgaaatattaatggtctaagagtgttgattatattgaacgattaattaacatgttttatgtcggaaacaaggcattcaatttacactattatctttatttaccttattaaactaatatatattctattcccccccctgattcacatccaatcgaactaagtcttggttgaatgctttaattttattaattctttttataatgaataactataaacaatattattagtgtagaagattaaataatttcatttttattacaatatgaattaataattgtttttcaaaaaattccatgttataatttggtaaaccactgaaatttaaggagggttttatgagtaaagtatttgataaagaagaaatccttaaattgattccgtgttctgacaaaattgactatatatacttagcggggtcaataatggaaggtttcggaaatgatgcttcagatattgatgtttttgttataagtgaaaatccagatagactagcttatgaacctactaattttacaagagaagtaaacatacaagtaggagaatcattcataaaaaatattgttatagacagtattagatatgattttgagtactatcgttcttctagttttacttctttaatagaaaagttgaataatttgaattttaatacagaaaattatattccaaggtttacagcagatgaaatagatcttttacatagattaaaatttgctgagccgcttctgaataaaagtgcttttaatactattctaaacaatataaattttgaaaatttaaataattatttagtaataactaatattgagtcatatgatggacatttagaagacttacagggagctctttcttgttctgattttggtacttcatttgtgcttttaaaattattattaaaatattctcttaatgcttatttagcgaaatatggagagacaaatccaggagaaaaatggttatttagaaaattaagtagatacgccgaaaaacatggtgatcaacatttacttgataagtatcttaatttattatgttatccttttgagaaagataatatcaaacattatgctcaaaaaactattaattttactcaaccattaattatcaaagctcaaaaataaaaacggagggaagtaatcacatgatttatcaaaaaaatatgtttgtgagattccgtatcatcgatactaaaccttatcttattcttaatgacaatgcatttatcttagacgatgtaggcgttaatatttgggaatcaattgatagcaaaaaaaatattgaagaaataataaataaaatctcaaatgtttactcagtagagtctaataaaataactaaagatattaagaattatttaaaagatcttgaaaaaaacggattaattgaagtgtgtaaagaaatctcataggtagttaataatgtctggaatgggctcctttagtggaggtgagattaatgtataaaaagcctgtattaattaaggtgaagcttcctgttgcgttagagtttgtttaattactacttaactgattgacctatcttttatgaattgaggtgagattaatgtataaaaagcctgtattaattaaggtgaagcttcctgttgcgttagagtttgtttaaatctaaaaccagactaaaataattgatcaaaaaatcaaaggagcccatccctaacattattattaaatcaacaactactcataaaattttaggagtaaggtatacattatgctattagaagaagttttcacgtatatagttctttttgttatagttaaaacatgtatgtttcttataaggaaaattaggggtaatcttttatttgatgtgctaaggaatttattatttttcgtcccttttattttaccagcactttatttaggcttacctaatttaatttttcaaggttcgattaattattatttattatccattttttcatcatttttagctttaagcattaagtataaagaatttaaaccttacttcaataaaaatttttaccaaatcctcccgaaaatttcttttaaagactttttaatattggaaatatctttgataggaagcgctatttttgaagagtttttttacaggagttttgctcctcactcctcttttattgtaggcatggcattgtcaggaatcctatttagtattgctcattatatacagaactatacaagaagttttttcgatttaaagacatatattttattgtttttattaggaatggtttggtattggagttataaaaatactgggactttaattccagcaattttaggtcatttagtatataaccttcctagtatgattttcacctattttcactttaaatcatcaagatttcggtgaggaaaaagggggttataatagtgagtagaatcataattgcaactataaaaagaaattatatagtttcaaagagagtttttccttggtcttttattatagccagagttcttatgggaatctatgtttctgtatttgctttttttacttttaaatatatgtttgatggaaaaacagaaagtcattttttaaagtatagtaatgggatagactatataagctttgtagttctaggagccggtctttatacatattctatatctgtaataatgaatgtaggtagatctcttatgttagaaaatatagaaggtactttagaaagtatacttgtctcaccgtgttcacgtttagggtactttttaggagttttttttgaacaaataggtagatcaagtttagagtttctaatagttatatttttcagtttatatttaggtgccaatattgaaattgagaacactattccacttttaatagtaatcattattactacaatatctcttttcagtattggtatatttatagctactctaatgttatttctacgcgacacctatataacacagaatactttatttatagttatgggattagttagtggagtatcttttccgagggagtacttacctaatatcctctactatttatcctatttgtccccattatcttatgcactttctttattccgaggtgttatgacaggacaaaacattttaaattacacaaaggaaatcttggacatatttgtcttgagcctagcttattgtctttttggtttactttggcttaaatgtctggaaaaaaaaatattagaaaatacatttaactaagggtgatagtaaatgctaattgccaaggatattagtaaaacttatatattgaatgagagaaaaggtttttttataaaaaaaaaaacagagattaatgccttgaaaaagctgaacttaacaattaagccgggtagtattgtagggttattaggagttaatggcgcgggaaaaagcacaactattaaaatattatcgaccattctagcgccaactactggctccttgaaagttaatgaagtcgatgcattaaaatatcctgtagaagcaaaaaaattgttaaacgtaataactggtggtgaaagaaatttatattggaggttaactgctagagaaaacctcgaatactttggagcattatatggactatctaaaaaagaacttaaagactatataccatcatcacttagtttggttggattaaaagactcaaatataccagtcgagagatattcaaaagggatgaaacaaagattacaaattgctagggggctagtaaataatcctaaatatttatttttagatgaacctacattaggcttagacataaatattgcaaaagatttaaggcaatacataaaaaaattagctcaccaaaaaaacaaggggatattattaactacccactatttatctgaagttgaggagctatgcgattgggtttatataattgacaaaggaaatttgctcacagaaggcactccttcagatattgtatcaaaaataataccagaaattcaattgaaaatagaattgtcaaatctaagttgtgaattaaaaaaagaattattgtactatgttggtgcaatagatgctaaaatacattttttcaaagatcatactaattactcgattttattatcatcgaaagacgatttaacttctgatttggttaatattataacaaaatacagaacttccattctaagttttaaaaccgaagaacctaatcttgaggatgcattattaacattaacaagtaaacaaggtgattcaatttatgaattggttaaaggtaattaaagctgaaatatataaacaacataagaattcatttcattcaacaaaagcttatttttcattattaatatggccaatattaaacttaattaatgcctacttatgttacaagccttttaatttaaacgatttaaaattatatagaattaatacatctgacgaattaatatcctttttattaataggttttttcacttatatttcttttaagtcgttaatgcaaagtgctttacaaatgagttatgaaagatcaaatggaactttggaaacaatattcttatccccagcaaatcgtttatcattaatatacggaagaagcttaggatttatattcggtaatatatggatgttttttgcgtttactttttttataatgtgttatatcggatcaatacctatatataatttagtctattttccaatatgtttcattctaatcgtcatttcagcaactttatggggaggcttattaaatactatctttcttttttctcgagatgcttcgatattgtttatgattattgatgatcctatgatgttattttcaggtgtgagaattcctctaactcttttcccaatatgggcacaagtaatttcttttatatttcctctcactcatgttttagctgtagtcagagacttaatgttatttggagatatctcgttatcctcatggaatcatttattatacttattatcagaattattatttatgtatatgataactttatttttgctatcaaaagctgaaaaacatgcccgtattaatggagaattaaccttttattgaataggttaaaaaaaagtaaaaaatacttaattaaagtattttttactaaatttatttcttatagtttattttttaaactacatgttttttatacttttatttagcttgattacattgttaactaaggagaaatacctttgtctaaaggtgtttctttccttagttaacaaatcaatctccaatcatcttactttttttctgacagccatttggcaataacggcggcttccttatcatctacaagccccttcggcatattgccgcggccgtttttaataatgctttcaattttgtcttcgtcgtatttgcctccgacctcttgaagattaggccctgacacaccttctaaatccttgccgtggcagcctacgcagctttgctgatataattcttccccttcagatgcagaggcttcagtcttgctgcctgtatctgtcttctcttcttttgcatcatttgaaccgcaggcagccaaaagaactgaaagcgtaaatacaagcattagtatcgataactttgatttcatgttgagaagcacaactcctttacgatctcttccatattataacctcgtttaagcacgtttgaaaccctcgcccagcacctcacttgcatccgccacaatcacaaaagctgactcatcaatctgtttgacgatttgtttcaatttggtgaattcagtttgcccaaccacgcacattaaaatcggacggtcatcgtcagtatatccgccgactgcagagatttttgtcacgcctctgtcaatcttctgtaagacagcctccttgacagcctgctcctgctttgtaatgatgagcgccatttttgaacgattaaagccgacttgcacaacatcaatggttttgctggacacatagacgccaagcatggcatataagccttgctcaatattaaatacaatcatagccgtaacaacgatcattccgtcaatgatggcgagacacttccccaatgacagaccggagtacttatgaatgatctgtgcagccaaggctgttcctcccgtcgatcctttccctaagtacacaataccaattccgatacctatcccgacaccgccaaaaatcgccgccaggagttcatgatgagtggcgggctgaatatcccttgtcagaaacactactagcggcaaaaacacagaacctgcaagcgtctttagtccaaatttcccgccgagcaaaatgacgccagcaataaataaagggatattaataatccactgtacatacgctgcttcaaaaccatatgattgtaaaatcgtactgatcccgctgacaccgccggcggcaatcttgttcggaagcaaaaatacattaaaggacacggccgtaatcgctgctcctatcaatatgtatacataatcccgcaaaatccacaatgttttattccgtacgtccatcatatatcctccgtttcttccaatgctctccgatagcattttaatccttccctgattagatgtaaataacacccaaatacagtggtaatatgctaaagcagcagtgaaatcaaggatataaggaattaaaaaaacacacccgttgcatcaggtgtgtttttcagcttatgaaagcttagaacgcaggtaggcatcaataaacgtatcaatgtcaccatccattacagcttgaacgttccccatttctgtattggtccgatgatcttttaccatggaatacggatggaatacataagaacggatttggctgccccagccgatttctttttgttcaccgcgaatttcatccagctctgcctgctgctcttcaattctgcgctgatacagcttggccttcagcattttcatggctctttcacggtttttaatttgtgagcgctccgtttggcatgtcacaactacgttcgtcggcaagtgagtaatccgaacggctgaatccgtcgtattgacgtgctgtccgcccgcgccgcttgcacggtacgtgtcaactttaatatcctccgtacgaatatcaatatcaatttcatcgttaaattcaggcatgacttcacatgaaacgaaagatgtgtggcggcggcctgatgaatcaaatggtgagatccgcacaagacgatggacacctttttctgctttgagatacccgtaagcgttgtgtcctttgatgagcaatgtcactgacttgattccagcctcgtcacctggaaggtaatcgagtgtttctactttaaagccgcggcgctctccccatcttgtatacattctaagaagcatagagccccagtcctgtgactctgtaccgccagcaccagggtgcagttctaaaatcgcgttatttttatcatacggctcgctgagaagaagctgaagctcaaactcattgaactcttttgttaatgattttagttctttttcaagctcaagctggagatcagtgtccggctcttctttcaaaagatcatgagtcatttgtaattcttcgtgggattcattcaattttttatacgaattgacataatcctttaaaccgtttgcttcatttataaccgtttgagctttttgctgatcattccagaattccggatcagccatttgttcatctagctcagcaatgcgggcctcctttgattcgaggtcaaagagaccccctaaagtccgctaaacgagaagccatattttcgagctctgctctgatttctgataattccatttcattcacctcattaaaagatccgcaggcgcctgcacgcgccgcggtcagtaaacttgccggggcgaactattcagtacggccgcagcaatttttatattttttcccgcttccgcagtggcatggggcatttcgtccgatatcaaccactttgcgaaccggtgctttctttgcttttttgttatcgtcgccttcttgcggctgatgagctgttgtttggccttgtacaacctcttcacgctccagattgttttcaatctcagctttcatcacaaattttgcgacttcgtcctcaattgattcaatcatatgctcaaacatcgcaaagccttccatttgatactcacgaagcgggttcgtctgcgcgtaagcacgaaggtgaatcccttggcggagctgatccatcgcatcaatatgatccatccatttagaatcaacggcacgaagaacgataactttttcgaattcgcgcatttgctctttgccgaattgctcttccttctcattatattttgtgatgatgcgatccataatgagctcaagcatttcatccggttctttcccgaagatatcgctcttctcaagcgcaccttcatcaagataagttgtgttgataagatcaactagaccgtcaagcttccactcctcaggaagctcttctcttggcgtatagactgcaattgcgcgttcgagagaagacttgatcatattttcaacgatttcacgcaggttttcagagtcaatgacttcaaagcgctgcttataaatgacctcacgctgctggcggagaacatcatcatattgcagaagctgtttacgcgaatcgaagttattgccttcgacacgtttttgtgacgattcaaccgcgcgagataccattttgctttggattggagtagagtcgtccatgccgaagcggtccagcatcgccattgtccgctcagctccgaatctgcgcatcaattcatcttccatagaaagataaaattgagtaatccccgggtctccctgacgtccggaacgacctcgaagctgattgtcaatccggcgtgattcatgtcgttctgttccgacaacagcgagcccgccaagctcttttacaccttcgccaagcttaatgtccgttccgcgccccgccatgttagtcgcaatcgtaactgcgcctttttggccggcctcttcaatgatctgcgcttcacgttcatggtttttggcatttaacacttgatgcggaattcctttgtttttaagcagcttagaaatcaattcagatgtttcaacggcaaccgtaccgacgagaacaggctgtcccgtcatgtaacgctgtgcgacatcctccgcaactgccttaaactttccttccatcgtgcggtaaattaaatccggtcggtcatcacggacaacaggcctgttggtagggatcgtgacaacctgcatgttgtagatgttgcggaattcttcttcctctgtcttagctgtacccgtcataccggcaagtttttcgtacatccggaagtagttttggaatgtaatcgtcgccaaggtcatgctttcgttttgaatctcaagcccttccttcgcttcaatcgcttggtgaagcccctcactgtagcggcggcctttcatcagacgtcccgtgaaggaatcaacaataacaacctgtccgtcttccactacatagtcaacgtccttttgcatcgcaacgtgagcttttaaggcctggttgatatggtggttgagcgcgacatgcttcacatcaaagaggttatcgatgccgaatgctttttccgccttcgtcattccttcttcagtaagctgtacagcttttgttttgatatcgtacgtgtaatccttctccgcttttaacgtgcggacaaaagcatttgcctgtacgtacagcttagtggattttgcagcttgtccagaaatgataagcggtgttcttgcttcatcaattaaaatagagtcaacttcatctattaccgcaaaatgaagcgggcgctgaaccatctgctctttataaagaaccatattgtcacgcaaatagtcgaagccaagctcgttgtttgtggagtaagtaatatcagcggcataagcttcccgtttttcgtcttttgacattgagtttaaattcaaaccgacagtcaaaccgagaaactcgaaaattttccccatttgctcagcgtcacggcttgccaagtattcgttgacagtcacgacgtgtacgcctttaccggttaacgcatttaaataaacaggcagggtagacgttaatgttttcccttcccctgttttcatttccgctatatttccgtcatgaagcgccacgccccccatgagctggactttaaacggaaacatgcctgttacgcggcgtgaagcttctcgaacaacagcgaaagcttcaacaagaagatcatccgttgtcgcccctttttcaagacgctctttaaattcaattgttttatgtttcaacgcgtcgtcagagagattttcatagtctccgcgaatcgcatcaatatcgttagcaattttttcgtatctattcagcgtacgttttgttggatcaaacattttatttaaaattccaagcatttataacgctcctctatcttcacatgcctattttagaggcatgtataaataatttactagtccatgtatacctctcattatcatatcataccttttgttatttccaaagaatttgcaaataagaaaaacaaaaaccttccgcggacatcacggaaggcttctcttcattattcagtcggttcaattaagccatatttcccgtcatttctgcggtacacgacatttgtaaggtttgtttccgcatttgtgaaaacaaagaaattatggccgagcatattcatttgcaagatcgcttcttcactatccatcggctttaaattaaagcgtttctgacggacgatgtccaagctctcctcctcttctatgtcatcctgaaccgcaatatctgtatcagagccaagaccgtttgccaataaatattttggagagccctgctcacggaatttacggtttactttcgttttatgcttacggatttgacgttccagtttgtttgttgcgagatcaattgcgttgtacatatcctcgttatgcacctcggaccgaagcgccagatctgtcatcggaatcgtaacctcaaccttagactccttgtcattgtaaaacttcaagttgacgttcacatcagcatccacgctatggtcaaaatagcgctccagcttgccgatcttcctctcgacatgatcctttaacgcgggtgtcacttcaatattttctcctctgatgttatagttcatcaaagaacgcctcccttttattaaggatatgtatctatttctcttttaccctttacaattcctgctgaaacataaatcttttgtgaaaattcagtgaactttgtcgaattttgtttgtatttgctctgttattggcggttcggaggtatatgtatatgctgattgaacgaaacaaatacctcacacacgcctaattgattaaaaagggttccatacattgatgaatagacagcatccattttctataatgaatcagaaaatgttcctttaaatactcacagaactcatgagagggaaaagagaaagagaccaattgatcaaactccgcaaaaatttggtcaaatgctttcacacaaatttcagcacaccgcgaatccataatgaagagaagtgttgaatgtgttgaatccaaataaaaaaaggcttggatcagatcttggtagatccgatccccttctgtttttgataaattctcttcagcctctatcaaataacacaacccctcttcgatggtaaaaagaagatgataataagctgataaaagcgtataatcttcaatgctcttcaaggcactcacctatttacgcttgtcataatatgtgccgtcaatcgtaatgttgttataagggtttaaatacgtcgtatgcatcacacgttttcttttcatctgctgaagttctgttgcgattgactgcttcagtctttccatttccttcacaatcagctgatcccatgtcaaaataagtttcatctgctttctctcttcttctgaaagcggcagagatatctcctgaatcagttcagaccgtgtagccacaaagtcttcaatttgctttaaaagttcatcgctttccggcgtattttgtatgtgtgacagcatactcttcgtctcagtgtatagttgatctatattattcatgcgatcccgcctgatccgtgccggtccttccgttcactttgaattgcttgtttccaagcatcgcgaaaatctgttacataaccttcaacctcagccagcatgcccgtatcatttttgatatttgcctgtaccaatctgcgatacatataatcgtacatcgcacccatagaagcggaaagctctatgttacggttaagtgtaaaatttaattcctgaataatattttgcgctttaatcagattttcatttttacgttccatatcatcattctcaatggcctgagcggcaagtcttataaatttcaaacagccattatacagcataagcgtcagctcaccgggtgtagccgtattcactgaattttgctgataggctgtataaggattttggatcgccatgtgtcatcctccaaattacatttattgtgctagaagctgtgataaataggacgattgttcgttcattttttgaatcgcagaatccattgcactgaattttgaataatagcggttttctattgtggtcaaccggtcctgcattttggtaatatcagtgctgatcgtatttaaatttttaccgattgaataatcattggttcccattgtcgagttgccggcttttgcttcaatgctcttcaccgtacttttcagggtgtcaccgatgcgtttcataatccctttatcactataggcgctgctgttcgatccacttgtaaataaagcggcgacactttgcggatcttcttgtattttagctttcagtttgtcttcattaatttctagatgtcctcgcatttggtaagcaccagacgttgtgatgccaaattcagttaattgataggtttttccatccgcactaacttgagaataaaaatcagtccgcatttgattcgtaccagtgcttatgctggtatcatttttcagcaaaccgctttttgccttctcttcccagagttctatctctttatcggacatggcttctttttgttcactcgtcagcggcgcatagtctctgtatttttcttctttcaacttttcattcaggctgtcaaccagttcattgtatttattcacaaactctttaatttggttgtaaatcccgtcaacatcagtagatacagatgtggtaacagggcctgtggctgcagttgtatttttgatcgaataagtaacgccattcactgtgaagttgtttgacagcttctccatttcaaagccgttgatggtgacttttgcattcgttccttctttgtaagcagtaatcttattatcagtgtccaaagaaaaacctagctggccagacataaaatctgctgtagcagagtctgctgcttgtatactgcctcctgcacctgttgctttagaagaaaacgcaatggtttccacatactctgtaccattccaaattttatctttaaaagctgatactcctagatctgagctgttaagtttagaaatcacattatcaatcgtatcagcgctcgtcacactaatgttcactgtttttgcggctgtctcaccaggcgcaacaacgttaaatgccaaattataatcgccctgtgtgtatcctgtataattgtttgccttatatgtcgcagcagttgccaaacttgctacttcaatagtagatgaagagtttgctgcacttgcagttcctgtagcagttaacacagattcgtttgagcttgatacggttttactctgaaacgtactcggatatgtcagcttattattagacatataatcttggaattcttttattttcgagtttacttcacgatagctatcacgctgccattcaagagtctgctttttttgtgttagcttattaagcggtgctctttctgtctgcatcagctttgatacaatatcatctatatccattcctgacgccagacctgttattctcgtgaccatttcaaaccactcctaatctactttttttcatctacaaataacccaagaaattcagtcatagctgcataaaaatctagccaccgccttggcggaatttcacggatcacttcatttgtagagtcctctattacttttacatagtattcatttaacttctcatggagctcaaacttcagatgaacttgcgaaggttccaaaaacttgttcattccctctaccatttcagcaaggtcggtatatgaaacttgatgaacaggaacctcactctcatgatctttctgattatgtatttgagtatcatagcgatcccaaacaggttgtaacgtagtgagcctttcaatgttcaattgatcatcccctatgccccaatctatcgtttatatcgactaaatcgagataacattacacatatttttggaaaaaatctcatccgttttagatttcttagtttggaaatacgtttataaaaagtaagtggagaatccggttattatatcatgatttaataacagcaagtggaatgattcggagttagaaatataaataaaagaccttggcaacgccaaggtcctctctaaaattaacgtaacaattgaagcacgttttgcggctgttggttcgcttgagcaagcattgcttgagaagcttgagaaagaatgttgttctttgtgaactcgctcatttctttcgccatgtcaacgtcacggatacgagactcagcagctgttaagttttcagaagaagcactaaggttgttaattgtgtgctctaagcggttttgtaccgcaccaagttttgaacgttggcttgaaacgctagtaattgcagtatcgattttcgcgatctcagtgtcaaaactaaaagtagctgatgaaacatcgatcccttttactcctaaagttgttgcatccatgttgccaattgtaacattaatgttttgggtagcatttgcaccaatttggaatgtaaatcctgctgttacactaccgtctaaaagtttttttccgttaaattcagtacgttgagagataccatcgatctcttcagttaaagcatccatttcatctttaattgcagttaaatcttcaggttgctgtgtacctgtgttaccagcttgaacagtaagttcacgcatacgttgaaggatggcatgagtttcagtcaatgcaccctcagctgtttggataagagagattccgtcttgagagtttttagaagccatatcaagacctctgatttgtcctctcattttttcagagatcgcaagaccagctgcgtcatctcccgcacggttgatacgaagacctgaagaaagtttctccatgttcttttgtgctgcaccgttgtttgaagacaaacggttcagtgtgttaagcgctgcgatattgtggttaattctcatttttatttcctccctgaatatgttgtttaggcacgtccttgtgcctcaattttgtaatcggcgagccatttgtgccctctcccggctacatcattaatatcggattgtctctgattttgttaatacaaaaataaaaaaatcctcactttttttgtgaggataatgcggagatcacatcgctggataacgacgccgcacggttattttcttcctgaatggttaaataaatctctttccgatgaatatcaatatgctttggggcttcaattccaagcttcacttgatccccctcaaccgcaatcacttttacttcaatatcagcacctatttgaatcgcttcgcttattttccgcgataaaactagcatgattctcctccaatcggatgctttgtcgtatatgaggagtcgtgtaaaacgacttgcttagccatcatgttcttgcgattcacaataatgggagccaataaattcgcagtagacttttcaaatggctctgccatagtcaatattgtcatgacttctacgtcttgaatattatcgatatccaaaagttcagcagttgattcatcaagatcaaattcataattcttaaaaaagataaacggacttacgacgataaacgcaagattttctgaagtgacggactgcagtgccacgaatggagagtcttctgaaagcggaagtatgacaaattgtttttcttctaaaaagcctggaatcccgctttcaaaaagaatgatttgttcttcttttatgttcatttggccatggtacttcgtatgaatgatcattgttcacgatccttttctttttacttttcgggtgattctttcgggtattctacatctatatttaaatcagggtattggagcatgtcaaccttaacatttcctggcgtatattcaacaattggcttatgcggctcagcctgaataacaggctttcgcggcgtaatctgaacatcaagctgtgacggagtatattgtattttcaccctagatagagaaggagcataattttcgcctaattgaatttggtgcatttcagagttcctccttgcttgtgaagcgattgggttccccttattttcaatcctcataagctcgtcgccttcttctgcagtacgcgctattccctccattacatcctcatgcccttgttgtgcggcttcttcaattctcttgaaaacatgctttctgtctaattcttcccatgcttgtgtctggtcaatcgtgagttttccaggtgtcaccgatatttccatttccgcactcggctgttcgatctctagatcagcttgaggctgctccatttttaagctggcaggcgtcgttgttaaaccaatttttccttgaacactatgcataatcaatctgggaatctgcatcactctacctcctgaactataaaaaaagcgaactcctgagagccgcttactttaaaaagtcaattaatgtaggctgaacaatttgcgcattaacggccagagtagccctgtgcacactttgctgcgcaataaattcagttattacttcttccagttctacatcttcattgtctgataacactttggtagctgtttcttcttgcgctgacagtcttgtattaaccaattcaagacgattatatctcgctccaagatcagatcgttcagcactcatgccgtcagaaaaatgatcaatatcatctaaaacactgtccatgccatctagcgaaccagaatttagtgctttctcaaaagaatcaagcatttcaaatacattctgcccgctttcagaagtgcctccaaaagctgactttggatctgaattcactttcaatgacatattatttgatatattgactacgacatcagctgtatcagaaattgtataagttccgtctccgttatctgtaaccggaggcttatctgaatttgtgccattaaagatatatctgccgttcacttgtgtattcgcaatatttaaaagctgttcctttaactgctttacctctacgccaatcgcttgccgctccgactcgccgtttgtatcattttgagcttcaaccgctaattctctgacctttgacaagatgtcaattccttctgtaatgtttgtttctgtgttttcgagccaggtaaaggcttgagaagcattgcttttgtactgctgcacttgagacagttgcgtattatactttaagcttttcattgctactacaggatcgtcggaagcttttgagatttttttccctgaagaaatctgcgactggagtttatccagcttcgagtagctcgaaccgatatatctcagtgagttttgctgtatcatgccttgtgttactctcatgtgactctacctaccttcctccaacacccatgccgttgatcactttatcaagtaattcgtcttgtaaagtcaccattcttgcagctgcattgtatgcatgttggaattgaatcatattcgtcatttcttcgtctaaagaaactgcgctcatttgctgacggtttatgtcagcatcatttagctgtgtttctgtattagacgccagtcgattagcctcttgagcttcgatccctagctcgccaatcagacccgcataataatctaaaacactagtttctttaccgttaatggttattttaccggttaaaacatttgctaattttgtagcatttgcgttatcgttggctgcaccagtcagtgagaaagcaatgtttgcgccttttgaatctattatgctgtcagccactttgatcttgcccgccgcgcccttggcaggttcagtttcaccgccagtaaaatcaaaaaagtctccgccttgttcaccgctcttggtcacaccatttctgtgcacttcattgaaagctttcgcgaattcaagcgccatattgtcaagatcagaaagcatttccgggtatacgcccttttcttggccgtctgctgttatatacccgtaagactctataaatcctaaaagggatcccttgctgctaaaggactccgcctgcacagctgtatccccgattgaaatacttgatactaacccagtttcattatcatagttggctgcaagttctgaaacctcgtaatttttaccgtccaaaacagttcctagcgactgtttatttttatcaaggatttcaattgatacagttccttcagcagatgcaagtgcattcccgcctgatttgttgtagttgactttgatatcaaccattgaggataatttatcgatcagcaaatctcgctggtcatataaaccattcggaagaagcccgaccggctctacttgtgcaatttgcttatttaaactgtttaattgagaaagcagagaattgacatccaacacagttgtatttagctctgcttttaaattcgattggacatttgtaagtgattcagaaatataattaaacgtttcagctacagcttgtccttttcgagcaacaacagaacgtgcactttcttcatttgtattattcgataattcctgcagagaattccaaaacgaattgagcacactgttcaagccgctgtcatccgtttcatttaaaacgccttccatttgggacagcgctttggccttcgtgtcatagtatccggcactgttgttttgaagacggtattggtagtcaagaaagatatctcttattctctcaactgattttccttgaacgcccgtacccatttgtcccgctgttttttctgcgtttttagatacagcagggaaatagtcagttgcttccaatgagacccgctgtcttgtataaccatcagtattggcatttgccacgttatttgcagtcgtgcttaacgctgcctgctgagcgcttaacgcccgccttgcagtttcaagccccataaaggtagatgtcattttctgaattcctttctgctaagcttttgaatcaaacagtttcattttgctgcttttcggcagctcagctttaattgatttgctgtaattgaagttattttccttaggaaccagcatatcgtacgaaatagagatgaattgcagcgcgtctcttgtcagctgcctattcatctcatttacttttttcagacgtccgagaacttgagaaagagattcgtatagttgttccagctcttccttttcactgcctgaggttttggtgatacatgcggaaatagtattattttcgctatatccgagaaaggccgaagttgttttgatccggtcatcttctgtctgcgtgattgcttgaatatatttttgctcttttgtcaaaatgttagaaagctcttttgttttgccggctttgagcgcttccgtcttttcttcagacagcgtgagcaggtgctcatgcagaacgcaaagtcgcttcaattgttcaataattgccttcgctgacatgggctttctccttttttattgctttttataaaaattaatcatatttttcgcgatatgatttgcgtctactttgtatgacccgttttcaatttgcgctttaagctgcgcaattttttcctgtcgtgaaccagtgactgcgtcggatgcatgttgcatttctttagcctgtgatgaaatttcaattttatcttgaggctgtgcagcagttttttgcaccgcttgcttatcataatttttttgatatggattaacggattgtgttccaaattgattgattttcataggattcctctcgctttccgttgcagtctttaaacaatcttaacccttttatcgactgcgttttcagttagtttagggaatcagctgtttttggtattataggcatagtatgtgtcttttttactattttctttctcgattttcagagcatcctcgtggttcaaatgatccatttgatccttaatatcggactggcaagccttgcagaatttgccttctctaatcgatgtcccgcacctttcacaagggtatgccaaattaggaagatgagtgatctgaattcgcttctgcctgatgaatttcaatatcagctcttcttccacacctgtttcctcagttatccggctcaaagttgattgccggttttcctgttttcttaaaaatttatagacagtctcaaatgatttttcttcttccttaatacacgcctgacatacggtttgcagctttgtttttaaaaataaagcattgcatttcggacaattagccagttctcccatcttttttctccttattagataatatgcctgtgtcaatttctagtgattatatcggcataaaaacagaatcatttagcttctgatcaaggtaaaagatgacactgaagcggcttttcctttttctaataagcagcgggctgcgaagtgcaaggtggcgcctgttgtataaagatcgtctattaaaatgatattcatacctgctgctgaattattttttgtatcaaaaatgcgctctgacagcaggcgttctgttttctttttctttgactgcttctcattattcaggcgaatgaggggatggtgggaaggccgatctaaacattctgccaagagctgtgcctggttaaaaccgcgctcttcttcccgttccttgctcagcggaataggtacaagaacaaaatgcttatcggggtaagccttagaaaaggttgaagaaaaatcacttttaaatgcatttatgatttctgcatctcctctaaatttaaaacgggagagcgcttctttcatcatatcattatatgtgtaaactgaacggttttgacgcaatagcaaactgtctctgatccttgttctccacacctcgcaatccctgcatacggcatgaacagattgaggtctgccgcacagggggcagatatgtcctgtgattttctttaatttgcttctgcaagaataacaaaccttttcatcaggctttagtaaaaaaagggctctccatgtaacatcttgagaaaattgcgaatcacataataaacagatcagtttatgaatgcctcctcctgcttcgtttgacataaatcgcttggactctctgaaactactgcagcagattcagccaaaatgacaagcattgctgtgtttttttgtttatctaccagctcagctttcgtatatgcgatctttttaagatcagtaacgtaggatggactcactttgtttaaagaaagtgccaatacatcgttttggcatacttggcaagtacaggccatatgaagctggtccatatatcggtcgagcagttctttcattacgatttcttttgaattgacaagcatttttacagctcctcatcatcggttatatgagtatactgtaccacgttttcaaataatggctagtctgtacattcaacttttgctgccaattcattcatttcttttatatgctttcttgcatcgagcatactctttgttttgccgaagtgaaagtaaatgacatcgccgtccgcatattctttatgccggccggttcttcctgcaatttgaacaagtgcgctttccgtaaagatagacgattccgctcctagtacacccgtttgcaccttggggactgtgacgcctctttccagtattgttgttgtgattaatagatcgagctgaccatctctgaattgctgcactttctcctttctatgcttgtcttccgcgtgcacagatgcggttcggcaatgaacacctttaaagcacgcagcagccttttccagaatagaaacggaaggaacgaataaaaaaacaggcctcccttcttttacatgaaactctatccatcttttcaccgctggcggaattttatttcggtttaatttcttcttccagtttccacaccatacaaagcgcggttcgggtaaaggtttccggtggtgtcttgcggggatgcgaactgaatgtaactgtccgttcagtgcttttctttttaattctttaggaggtgttgcacttaaataaacgagggtgctgtttttctttcttgctttttgaacagcgaattgaagggtttgatcagcagaatatggaaaagcgtcaacttcatcaatgatcataacatcgattgcatctttatatcgcaaaagctgatgcgtagtggaaatcataagcggagatagccgccctttgtcatcgcttcctccgtaaagcgctgaaatgtcagcaccctgaaaggcagccttgagtcttggagcaagctctaatacaacatcggtgcgaggtgttgcaatacatacacgcagtccttgatttaacgctgattctataccaggaaacagcatttctgttttgccagcgccgcaaaccgcccagatgaggagctcttctttttttgatattgcttcaattaaaacattggcggctttttgctgtccgcttgaaagcttgccatcccatgtcagcttaatagacttccagtttgattcattttcctctttccatgaatataaaggaacctcctcactcactctgcccatcatgacacaggaacggcaatacagcttattctttccagatgagtgataaaaagaaaaataccgctgatcagtttgtccgcacctattacatctatatctccgtttatttatggatatagaattttcagcagtgatatatccattcttgatatgccattcaatcatctcatcggaaaatgagagctcagtcctgagcaaatgacggcttcgaagcgtctgctgcaattcttttgaaaaggaactgtttttttcaactggcacattcacatagcacgcctcctttcgaaacagtatgcctgaatgaatattttctgtccaactattaaaataagaatataaaaaaatctccgctctaaaaacggagatttggccttatttaaaacaccagcaaattcctaacgcaccttcacccaaatgagtgccgattaccgcgccaaaatagctgttataaaattcaacatgaggatattttgcagaaagctcttcaatgattttcgctgcttcttcctctcgattagcgtggataacagcagctcgcataggcaaccctttactcgcatcttcgtctaaaagctcataaattcgcgaaattgcttttttacgtgtgcgaatcttctcaaaaggcacaattaccttattgtcaaaatgaaggataggctttacctttagaagactaccaatgaaggcttgggcgctgcttaatcgcccgccgcgctgaagatgggctaagtcatctaccataaaataagctcgaactgtttttttcatttcttccagttcttttataatatcttccggcgatgatgctccgtttttgattaattcagcagctttaagggcataaaagccttgagccaagcagctgatctctgagtcaaatggatacacatcaatattgtcgaccatcgaatcagccgctgctgcactgctgaatgttccgctgatcccgctggaaagatggatactgataaccgcatcataagacttgccaagctcttcatacaacgcaaccagctcgccgattggcggctgagaagtcgtcgggagctcattatgttttttcacttcttcataaaagcttttccagtccaactcaatttcttcacggtaagtctcctccctaaaaacaacctggagagggatcatatgtatctgatgttgttcacgcatttctttcggaatatatgccgtgctgtctgttacgactgcaatattcatagcttcgatacctgccttattgctttataactctattgtaagggaaacggcagcctaaaaaaagacctgcctagtaaaaggcaagtctcctattatactatctcatttctacccagccatttttaatggcgaccacaacggcttgcgtccggtcgtttacattcattttttgtaaaatattgctgacatggtttttaacggttttctcactgataaacaatgattcaccaataccgcggttgctttttccgtctgcaagcatctgcagcacttcacattcccgcctagttaaaatatgtaatggtctgcggatttcagggtaaacctcatgttgagggtgtgcagaaactccgcttgttgcaaggcggcggaattcgttaacgaggttgtgagtaaccttcggatggaggtaagatccgccctcagccactactttaaccgcttcaattaatgtatcagcatccatctctttcagcagataacctcttgcacctgttttcagggcatgtgttacataattttcgtcatcgtgaattgatagaataattactttagattcaggatacagctctacaagctgttttgtagcttccacaccatttacgtttggcatattgatatccatgatcacaacatcaggatgatagtgctcaacaatacgagccgcttcgtctccgtcatcaccttcggctaccacttcaaaggtaggttcaaaatccaatatccgtttaacaccttcacgaaataactgatggtcgtcgataataacaatgtttactttagtcacaagccacgcctccttgtattattgttctatatactctagcattcggtcaatatgccttttggctctattttacaaatcatagtcaaagagataacggaaccttaatcataataaatgtcccaagacctattttcgaatctattgtcatcgttccttccaataaatctactctttctttcatgcccagcaagccgaatgatttgtttttcttctctttcgcttccttcaggtcgaaccctttaccgttatcttttatcattaaaatcacaaaatcctttgtgatctcaactttgactgtaatttcttcagattcagaatgctttagcgcattagacacagcttcctgtgcgagcctgaagagcgcaacctcaaactgaggcgctagcctctgatcctctgtttctccaatgcactgaaaatgtattttgaccttcccgttatattcctcggttgtatatagatattttcttaaagttggaatcaggcctaggtcatcaagggccatcggtcttaaatcatatataatccttctcacttcgtaaagggcattccgaacattttggcggagatttttaatttcttggaatccgtcctctgcgccccggtcacggaaaatccgctcgattaattccgatctcatcataacattcgccagcatttgagcgggtccgtcatggatttctcttgagactctttttcgctcttcttcctgcgcctcaataattcttaagccgaaatcctgttttgcctgagcatcagcaagaagcagtccaacttcgcgcaaatcctgattcaagtagttgagcacaactgtaatttggcttactaatgattctgaccgctcaatgatttcctgaagccctagcaatctgcgctccaaatcgtcccgccgttcgcgcaattgcttctcacgctgctggatcatcgtcaattctacctgcagcttatgggctttttcataagcattgcggatttcctcttcactgaatctatgaaaattacggctgacctcggataaacggtttctcgcatggcgggtttgcacttcaagtttatcgccaagctcaatcacttcatacacctgctgtttaatttgtttcagttcttcgaccagctgttcatactgctggcgtgactgctccccgatttgaaaaacctcgtccttgctcccgtcaacggttttcagcatcttcatcaaaatagaatccagcactttggaatccatctttgttttattcataatttccctccgtcacggcgttgtcatatatttttattataaatgtaattgatctgcaaattatgtcgaattataatgaaagaatgcgtatattctagaaaaaaacatttttatatactatctactctttatgataccaaaatacgcacaaaaattctaaagactgtacgaatttgtataggcagtcttttatgcttagcaggagggtcagctagcatgctgcacagctattttactgtgaaagaagcaggagaacacgagattgttatagaaaaatcgcgttttatctgtcatttaagccgtgtttctaccgaacaagaggcacaggaatttatacagaaaataaagaaacagcactggaatgcgactcataattgctcggcttatgttattggcgagaatgatcatatccaaaaagccaatgatgacggggaaccaagcggtacagcgggagtgccgatgctcgaggttttaaaaaaacgcagactgaaggatacttgcgccgtcgttacacgctacttcggaggcattaagcttggtgctggcggattaatacgcgcttatgggaaatcagtgtctgaaggattaaatcatataggtgttgtagaacggaagcttatgcgaatcatgcatacttctgcagattacacatggcttggcaagattgaaaatgaattaagggagtcacaatttctgttaaaggaaatccattattcagaaaatgttgaattcgaaacatacgtggaagaaaaggaaacaaatgctttttctgaatggatgacagaactgacaaatggaaagagtgatattaaagagggagagttgacgtatcttgaaaaagccgtcaatcacataaaggagactgaataatggctgaacgcgttagagtgcgtgtgcgaaaaaagaaaaagagcaaacgcaggaaaattataaaaagaataatgttattgttcgtcctcgcattattagtagttgtggggcttggcgggtataaactttataaaaccattaacgctgcggatgaatcgtacgatgccctatcccgcgggaataaatcaaatcttcgcaacgaagttgtcgacatgaagaaaaaaccgttttctattttatttatgggaatagaggattacgcgactaaaggacaaaaagggagatcagactctcttattgttgttaccctggatcccaaaaataaaaccatgaaaatgctgagcattccgcgtgacacacgtgtgcaattagctggtgacacaacgggaagcaagacgaagattaatgccgcttacagcaaaggcggtaaagatgagacagttgaaactgttgaaaacttcttgcaaatcccgattgataaatatgtcacagttgattttgacggatttaaagatgtgattaatgaagtcggcggtattgatgttgacgtgcctttcgatttcgatgaaaaaagtgatgtagacgaaagcaaacggatttacttcaaaaaaggcgtgatgcatttgaacggcgaagaagccttagcatatgcccggatgagaaaacaggataaacgcggagactttggccgtaatgacagacaaaaacaaatcttaaacgcgctgattgaccgcatgtcaagtgcaagcaacattgctaaaattgataaaatcgcagaaaaagccagcgaaaacgttgaaaccaatattcgcattactgaaggtttagcacttcagcagatttacagcggctttaccagcaaaaaaatcgacacattgagcattacaggttctgatttgtatttagggcctaacaacacatattactttgaacctgatgctacaaatctcgagaaagtcagaaaaacgcttcaagagcatttagattatactcctgatacaagcactggcactttcggtaccgaaagttcaacagacgggactgacagctcaagcagttctggcagcactggcacaacaactgacgggacgacgagcggaagcagctattcgaatgacagcagcacaagctcaaacaacagtacaacgaattcaacaactgattcatcctattaaaaaatgcccggtccttttaaaggatcgggcatttttgcgcagaaaaaaactccggcacataagccggagtttttaattccttttcaccagccgtttataaaactttgtaaacggcttaaatttttcattcacgagtcctgtcacttctgctatgatttgcataaaaataatcaaaatgaagataataaacaaagaaagccaaattgtggcacttttaagtacaatcgcactgatactgaaaataaatccaattaaataaataactaagaccgacatccgatgtgaaaggccaaaggccatcagtctatggtgaatatgcgacttatccggcgctgaaatcggctgtttgtttaatattcttctgatgatagcaaatgttgtatcaaaaatcggtacgcctaatataataatcgggataacgatactgaacaatgtgacacttttatacaggcctaataatgaaagaatcgaaatactataccctaaaaacagtgatcccgtatctcccataaagatttttgccggatggaagttgtaaaacaaaaaccccagcgtgctggcaataacgactaatgagagtgacagaatgagcacttttccgccggatagcgccatgacagcaatcgttgacaggccgataacagaaagaccggcagcaaggccatccaatccatcaatcaggttaattgcgttcgtgatgccgacaatccataataccgtcagcggataagccatccatcctaactcaaatcgttctgttaaaaaaggtactgagaaaaagtccatttttaagccagtgcttacaatcataatggctacacctaattgaatcaaaaacttaacttttgcacttaattgatatttatcgtcaagaatacctaacacaataatgatgaatgctccgactgtaattgccgtcatccttgtttctgtgtaaataccggatgcaagcacgcctgcaaccaccccgataaatatggccagcccgcccatgcggggcatgattttgtcatgtacttttcgattgctgggctggtcaactgcacctattttaatcgcaatcctttttacgattggggttatgattaaaactgtcagcagcgagacaataaacgcaacaacaatgcgaatcatgcgttcgtcaagcataaagaagtctcctttggaattaaatgaagtctttatttatatagagaaccgttccttccattataccttctccttagttattataacaagcttcatcaaaaagaaacacgtataatcaaaaaacgcgcatcccaatttataggactacgcatgtttttgaatccctgtatacttcataatttgtctaaataagcaattccaatcttgtgtgcgagcgatgtttcggcgcatttctttataggtttcgtctccgttttgtccgagaactttttcacaagctgctataaaatcaattggatgatcaccttctacatattcgtatacatacggcttttgcatttttgaggttgacggaagattagtgcctacaacaggttttcctgccgctaaaaattcaaatagtttcagcggaaacacagcttgattatacggtgattgtttatatggcatgatgccaatgtcgataagctccatataatgaggcacttcttttggatctgccggaccggtccatatgacatttggaagcctcagcagctcttgaaacgaaacgtcaccattggtggcatccgggccaacccataaaaatgtccaatcaggcttttgcagggcggcggctttaatcattttaaaatcgagcttcggtttaatcccgccaataaaacctaacactgttccttctctcccctgcagtatactgcgatcgggagcttgtttatttgcagaaaacagctcatactccacaccgttttccacagtatgaaccttttctcgtcctgcagtcagttttttgtctacttccttgtgaagataatctgatgaacaggttattgaatctgctcgttgtataattctcagctctgccgatttaatgacttttcgccggaattcagacagcagatttgatcggccgctgatcggcgccgcccataagtcactgcagtcataaatgacctgatcccaaggatacagcgaagacagcagcgggaatccgggaaacgtgtaccataaacagcaacgttcaccgtttgcagaagcaggtgtaagctcatcgagtaatggggagagcttatgtctgtaaaagacatctgtatatcgtccgaaacgaaacatttttttctgcagcaggtctttgacaacgaattgcctgatgccagaatggacttcttgaaattctttaccttgggcacgcggagccggacatacccaaataacttccttcgtttcctcctgagcagctaaaaattctgccagccggtgccttctgtatctcaattggtcttttccccattcagcagtggcaacgatgacatgaatgattgcttcttttgtttccaccttcatcaccttttctctctgtttgcggctataatctttttttcaccgcgttttttgcatattgaacaaaacaccatgttgctttcataaaatgaagccgttcgatctccctgtagacaaaccacgtttttttcgcagccttccatttgttgctggaaattgagttattgacaagccgatattcagccaggcattcattcattccataggcaataaatcctttttttaaaagagacagccatgtggctaagtcctgtctcgttctgatattcggcatttggatctgtcccgtttgctccctgtcaatcatcaccgtcaagcagccgataattgtatttttcagggcgtcatcgtacgtcaggctttccggcgcatgaataaatttatcgagtggggtcccgtcctgcgccattaagctgtagcccgtgaaagaaaacgcacaggagcgctccatcataaactcaagctgcttttccagtttgtcttttttccatttgtcatcactgtccaaaaatgctacgtagcgcccttgagcgcgttccaacgctttgttgcgagcaaccgcagctccggagttctcttccaaatacaccacatgaattctttcgtctattttttcatactgctgtaaaatgtcgcgggtcccatccgttgagcaatcatccacgataatcatttcccaatgaggatggctctgatctaataccgaatgaaccgtgtcttcaatatagtcacgcgcattataggaaggtgtaatgacagatacgagaggtttccaattggtcatgatcacatctccatcgtatgattttaaaaggattccctgaaaaattcaggaatgacaacgaacataaaggcaatcgtaaggccaatcataacgccgagaactgctttctttttcggagacattccgccgcctgctgtctcacttacggtttcggaatcagtaacacttgccgctttcaggttaagctgtgtgtttttgagctcatacaaaaatctctctttatccactttggaatcctcgcttaccgactcgccttcaagcgcgtctatgctgctgcggatgacggcttctctttctgcatacagcttttgatcgtttttgaggaaggtggaggaaatggcttttaagacagattccgttttatccttatcctcgtcgctatagcttaaagtcagtaacgatttggattccgttttgattgtaagcttctctttgatctctgctacatcttcatccttttcatcaggaagcgcctccttcaaaaaggagtcgctctttaatagaagcggaatctcttctgtgctgttataaaccggatgatcatagctccccacagccaaagtatcttcagctgtatagctcttttgatcagcgatctgtgacggcaggatataccccgccgcacctaatataattggcaccgctatgatccaaatgatatttttttttatgcgacgggctattcttatcaatatatcgttcatataagtctccctgctttttgtagtctgttttatctgtacatcggctcaggcatttgtctggatcgccttaacacattcacggccgcgatgacgagcgccataaacacccaatggaaaaataaatttgaaacagagcttgggctgatacttgataccaggaaactgaccatagcggtaataagtccttctgtgatcagttttgactgattttctaattttctttcataaaacttgtaaagcacccatatgaggtaggcataaacggacagatatcccagcatgatgaacaagccaaaattagcaagaatttcaacaagccagttatgcacctctgccacattgtcagtatcatatacagcataatgctcaagataataggatacatttcctgccccgactccgaatccgtatgaatcaaggaaaaaatgccaagcgtttttcagcagatttgcccgagccacatttgatggaagcctgtcatgaaatgaatgcagcgtctgcggggccagaaacagctcccaaaactttgaatagattttgctggcgaaaagaactgcgaaaagagcaattcccgccgccgacagccatatagccattctctttaaaacaggcggcaatacaatgaagatgtagacagcaatacctgcaaaaatgcccagaaggctggctcttgaaccagtggcaaaaattaaatacaacgcacagagcgagagcacaaggccaattgccttgatgtatccattcttaatgtttttcatcatcgtgatgtaaaaaaagaagctgatggataaaaaggtcgcaaagtcattttgattaaaaaagaccgatgtcggataatgctgcttgtactccggtccgctgtacaatgtggaactcgcaagatgatggtgggtgatatgattgtaaaaaccaatgatcatcagaaataccgtcatcaccagccaaatggcataaacaatcatcagccgctccattttttgcacgtacatgacaataagataaatgaagaagattcccattgccaataaggctaaatacttgaggccaactgttaccgacttggcccacagcagagaaacaaggccatatataaaccaaaaggcgaaaaagagtaaaatcccttttacttgcagcccatgccatctttcaatatgggttcgattccgaaccatgccgaaaatatgaaggcaacccgctgcaatgagcagaagccggtaaaggaacaaactgaaaaatccaagatgaatagcgaaaaatgcattatttaaaaaagtgcaggcgatcaaaatatagattacagccataaagagccgttcttttgttgtaaatgcggttgcaagcgtcagtaaaaacaggccaattgccaacaccgcaagcacaacagccatctgcatgaaacctatatctttatggatggctcccagcaataggacgactccaaatatagcagcggccagtaacgctagcgtatggaccgctgatcgtttgatactcacatgtttaacccctttcctgatgtttcaggagccggcggccgagcctagcagccggcagcttcaaccaagtaacactttttctttttataaattgacgcttcccaagtctttagccaattcttcaagcggcaagcccggaaaatacttgtcagagggttccgttccccgaacagcgggacggccgatagagtgataaatgtatccggctgcctgcatctcttcaagtgaaaataaatttctgccgtcgatgatgactggctgttttaagaggttttttacttttacaagctccatttcttttacttccggccaatccgttaaaatcaggcatgcatcagtgtcttcaatcgcagcatacacatctgtgtaatactcgacctgttcgccaaggatcgctgaagcttcaggaatagcaatcggatcgtatgcttttacatgggcgcccagctgctgcagcattgggataatatcaagcgctggagcggatctcacatcgttcgtattcggtttgaaggctaatcccaggactgaaatggttctccctttgacgcttcccataacagtcaaaagtttatctacaatatgaacacgctgcttttcgttcgtttcaatgacagcttcgatgagcttgaatggatagcctgccgattttgcgatttgaagcagcgcggttgtatcctttggaaaacatgaaccgccgaatccaatacccgctttaaggaactttctgccgatacggctgtcaagaccaacaccatcagcaacttttgaaacgtctgcgccaactcgctcacaaatgtttgcgatatcgttgataaaggaaatctttgtcgccagaaatgcattcgcggcgtatttaatcatttctgcactttctaggtttgttttaatgacaggagcatggaatggctgatgaagttcctcaatgatggcagcggctttatgacttgttgaaccaatcacggcacgctccatattcatcgtgtcatgaatcgctgacccttcccgaaggaattcagggttagatacaacatcaaatgagtatctcccctttgaggctttttgaacgatagattgcaccagtttccctgttccaaccgggactgtgcttttatttacgatcactttgtagccgttaagatgctcaccgattgttttcgccgccgctttgacgtacgttaaatcagcttcacctgttttggacataggcgttccgactgcaatataaataatatctgaggcccgaatggcggacgggatatcgttcgtaaaggtcaggcgctgatccagcacatttttttcaactaagtctgcaagccctggttcatagattgggattaccccatttttcagacttctgatttttgattcatcgatatcacagcaaacaactttattgccgatctccgcaaagcaagtgcctgatacgagtcctacataacctgttccaatgacagctatttttttcacagcgctcatccctctcctgtaaaatgatcttcctatttatattggtcgcagtttcttacgattaaacggacgttttcgtgaccgtctgatactgatgatgcaaggccttggcgttttttcctgcgtcaaattgagcctgcacggtttcatacaagtcatctgctacttccggcttccatatttgctcatgttcgtaccgagtgatcgcttctgccaaggcttgagcggatttcggtttaatcagcagatgttggtgctttccgaacaaagacgacactccgccaacatccgtacagataacaggaacccttagcgccagcgcctcaatcacaacagtcggcatcccctcactgtaagaaggaagcacgaatagatctgccgcaagtaaatagtctcttacatgatgattcggcacttggcctgtgacgatatgccccttctgcgtcagcgtcgattttgcgggaccatccccgacaaagactgcctgaggtgggtcctgcagcgattcgatcgcttcagacagttcaaaaatgcctttctctctgaccagccggccgacatagacagccagacgctgatcaagcgggagtccgagtctttctctgatttcctctttcgtctcctcattctcctgaaaacggctgagctgtatgccaattggcaaaaccgagctgtcaaagcccgaaagctttttggcttcttcctgaagcttgtggctgactgctaaaacaactgacgcagaacctacggcacgcttgaaggctttaaacgctcctttgctgtaatgcggatagacattcacatcactgccatgcaaggtcaggacataaggaatttgcgctgactctgacacgactgccgcagccccgcccgatggcatggcaaaatgagcatggatcagatccggatataggccgcgctgtttcatggtttttaaaacggctgatgcgattctccgatgaggctgcgcccacttcagctggccgggaactgcccgatagaaaggccggtaaaccggtatcccctttctaacctcatactccggtctggcatccttttttcgatatgtctttttcagcatgcggacaggcgctgaatgaaaaggccgtgggcatatcacagtgatatcaagcccgagtttttgcagctcttgcacctgtgtctcatgaaacacaccctctccgggtttcatactgctcggatatacgcttgtgatccacaaaatcttcatgacaaacgtccttttcttagtagtttgcttttcgtttgagggtacgcttttaccaaaagaaagagatagcacagcgccccggccgcaactgaaatggccagccgcatttctgcctgcatactgaagtgttcggtactgaggcttacaccaaacgcgatgatgcccatcgccgcagtaatcagaaatggcttcataatcgactggaaataagctgaaaggttaagcttgatgacatatgccaaaagccagcgcccaatcaggaaattaacaacgctgataatggcatacacccatgcgactgtcagcaggcttcccgtctgtacagctgcaaacagtgataatccgtacagcagcagcacgccggaatcccaataaaacgctaagtcagctcttcctttagccagcagcacagatccatttggattcataagcactcttagtattccgacaatcgccagaacatttaggatcggaacagcagcaagccacttttctccgaaaaccgctgtgataaaggcgtctgacacagacacgagcccgattaaaagcggaaacgagacaagcgccagcatttttgtcatattcagaaagccttctctgatcacgctgttttcatatttgttttttgcgaaaacagggaatgccacccgtgtgacaatcggattgatcttcaaaaccggaatggtgacaatctgataagcgaggttataaatccccaatgcttcagcaccaataaaccggccgatcaaaatcatatcgatatttgctcccagcctgttcacaagacgggatgaaagctgaaatgctccaaaagaaaagaaatccttcatgcctctcaaatcaaaaacaaaagcaggatgccaattttttcggtatactgcccaatataaaatccctttactggactgcagcaggacttgagaaatcacgtacgccaaaatcgcatccatcataaaaaccgctatcgctaaatatccgaatgacaatacatttgaaaaaatctctattttgcttaacgtattaaaatgcagctgcttttgcagcatatactgatattgctgtccaattggcgcgatcaaaaacataatcgccagaatccgaactagaaacaccagctcttctctttgataaaatcccgcaatgacaggactgctcacatataaaagaacaaacagcaaaacgcccgtcataatgttaagccaatacaatgttgacagctggcgctccgtcgcgtcgtctctctgaattaatgctgctccaaaacccatatcgagcacaatctgggcgaaaactgtaaccgttgtgatcatgccgacaagcccaaattctgttaaggtcatcatatttccaagcagggcaaactgaacaatttgtatgattgtaatacacatggttgaaatacttgtccactttgcaccgctcatgatttgttttgtaatacttggcatcatattccctacttctttttaagctcagattgatggtgaataatggcattccgttttatcttgcaccatcacccgtccaaactactttacaagtttttaacataatttttaattctaaagtgaaagtcagattgcgaatgtaatataaatcaaatatcagcttttccttcggcgtcatatcgtaaccgccgttcacttgagcccagccgctcaatcccggtttaacagccagacgctgtgtaaagcctggaatctcattctggaatttttccgtaaatacgggccgttccggacgagggccaatcatactcatatcgcctttcagcacattaaacagctgaggaagctcgtcaattctcgttcttctgataaaagctccgatccttgtcactcgcggatcttgcttctgtgcccaaaccgccccagacttctcggcatctattttcatggaacgaagcttataaagcttaaatggtttcccgcctttccctacgcgttcctgcgtataaatggcaggtcccggcgtctccaaacaaatcaaaattgaaaataccgcaatcattggcagcgcaatcgccaacccaatgagcgcaaaccaaatatccattacgcgctttattgccaaataacgagccgtcttttcagataatgtaaaagaatgtatttgctgaactgagaattcacgactcacattcatgcttttctctgcactcactgacacacacctcacgatttgtttgggatgttatgatgacctatgccagtcagtttagcagacggatgttaattggatgtaaatggtatgttaagaagtgtgaattacgtgttttttctgataaatgttgttaatactcttttactattttatatacaagtcctatttgttttaatcatttcatataaaaaagagacaaatctgtgattagatttgtctctttcgattatctgtaataagatactgtgccgtcatgaatagcttgtgcagctttatctttataaaccgcttgcttcaatttacttgcatctgatgcattagtgataaaggcagtttcaactaaaacactcggcattttagaatatttaataacatagaaagcggctgtttttactccccggtctctcgttccaagattagccgctaactttggttgaatttgttcagccagtctcttgctatttgcagcttgatatgttgtatcgtagtacgtctcacttccatttggtgatgagctatcattagcatttgcatgtatactgataaataaatctgcttgtgcagaagctgctttatttactctctcctgtaaagaataaaaagtatcattagatcttgacagtactggaagagcacctgaagtatttagctttgtattgactcttttcgctatatcaaggttgacttctttctcaaggagtccattgccgattgctcctgaatcttgatcaccgtgacccggatcaataaagattgtttcacctacaactggattctttagctgattagcaaccttggtgcttacggcaggagtgtttccgataatcgtaaagtttgacatgtttttacttccaataattttacgggctcctgtagataaattttcaccatttgtaaggataagagattgcttcttcttagctgccagtgtagctcctgcaatagagtcagggtagctgaatccattgcttacatatacgatgcttgttgataaattaagtttttgtacgatatttgcagcaagctcatatctgtttgaaccactaattcttgtaggagaaggtaacttgttgtataccgtattgctgatacttccagtgcctcctacaacaacggtactcgaaattcccttatcttttatcacagacgttgtcgcactatttatagatgttttatttgtaaaaagaattggatacccgtttttcgctgcataaggaatgacggccggagcgtctgcatataagaagccattcaaaataacagcttttgaagtcgcacccatcgcttttgccacccgtgcagccgtatcataacggttgcttcctgcaattcgtttaatacttatccccaaacttttaatctggttagcagtgttagatgaaacagcaggtgttccgcctacaataattacatttttagtctgcatctctttcaatcttgttttcgtttcatatgaaagcttatcagaattagtgtaaagcaatggcgcattcttctggtaagcaaggggtgctgctgaaatagcatctgcataggaactcccaccaacaattacagctgtacttgctgttgaatacatttgctttgatatttgtacagcagtgccgtatctattgcttcccccgactcttttcactgaattatcggccaaagctgttggcacaaaaagtatgagccccagaaaacacattgttaggacttttatataagaacgcaattgatttcctccttaagtggcgttatatcctaaaataatcaataacttgtcagagttgtacctggatagtaaaatttcaaaattgaactatatgaatctccagcttctgctcttgcttttgctccatattgactcattccgatcccgtgaccatatcctttaccgctgattgtgtactttgaagtatctttttttacagtcacataagtacttttaaatacagtcgctccaatcattgttcttaactcacttgttggtacactaatggttgtaattttgctcaagttataggagccagtactgcttttaacaaaatacttcactttcatcgatgctgtttttgcacgctgcccttgtgtcgttccactaaagcttaaatcgtcaatacttgcaattttgacagaatcagcgcttgtttctttatttttcaagatccagttcttaactccggaaagtcttgcagaatcagtttcagtcgctgaagaccaccaagaagaaggcttcgttaagtccaaagatttcgtatctagctgttgttttgacaaagtaagcgtccagcctatttgaggatcctttgtatctttttttgcaatcaagtaaggtacacttgatgaccacacttcattactagcttctgtgtaaccaccattactggaagaataagctgcagttataagagatccattatatttcagaactttccccttcgtttgctctaccgctttattggtattcgaattccaactgtagccaccataaacttgaaaagcggttgtatcaggtacagtagttcctgtttttgttattgagtaggttcttgcagcgacagtctgtgctttaagagcctcaagtgaccagctagcaggcatttcattcggaattactccttttaagtaatcctcaaatggaatattctcatttaccggtcggatatatttagtagactcaatagagaaattaaccgtgccaagatactgctttccatcaagactaattctgtttgaagtagaatagttttctggtttaattcttagggagtttccgtaagttttgatgttttcaaggtttaattttccgctgttgatttttagattataggtgctaccgtcagctaaataaaattcatcagcaagtgaattctcaacttcagcagaaattgaactggtacttccaataaagtcgtatgcatatgtggctttatctttcgttatacttttagccgcagccggaacgctatcttgtttaataaataaaatttggctgtttttcttcgaggcaagcgaagcgcctatcagtacgtctgcatattttgtcccgttcgtcattacgactttatcagccttcaactttagttgcttaattatatttgccgtaagttcatatctggttgatccaggaatcctttgcacagttgaagtttttttaatttggttttctacactatcactgacgctaaatgaactgcctataatgatgacttgttttggcaaattataatccggaagcttgtctttctctgtaagcaaaatagggtatccgtgtgctgctgcatatggagcaatggctaaagcgtcttgaaatactcttccggttacaacgatcgctttatcatagctgcccatttgctttgcaatattttctgataagacatatctattttttccgcttatccttttcacagcgccatatgatttcagcttgttttctacatcttttgaaatgcttcgcgctcccccaatgattaaaatattatcagggttaaacttagcaatttgtctttcagtagtttttgttaacgtgtcaggctgagtaaataaaactggtgcgttcagttttttcgccaatggaataacaggcaatgcatcaataaaaatatctcggttcaccaatatcactgtattaggatttttccactggctgttggatgcaagagtcgcagtttcgtatcgtgaagcgcctgcaaaacgatccgtaacagcaacattatctccagttactttataaaatcctgttggcgatagactgatgctagatttatttccaatataatttgacaatttaactgagatgtttgagtctgctgcaaaagaaactgatggaatcaataataagattgcagcaagtgaacacactatcaatcgtttgcaagatttcaaaatttcaggttcctccctatatcttagttggcacgttcaatatcttttaacagaagctgaccctcatcatttttttcatatgtaatcgtgaccttatctccactgttaaacttatcaagatcacttgtcgattcttcagtgatatcaagactaaccggctcattatctactgttacttctattgtatgagtatcagctaaccctacataagtaccttcttttgtttcaatgttactgtctggcgatacatcttcaccttgactcttttgactattaaccccgcaacccgaaagaagcaatataaagaacagtaaagcaataaattttttcatttttttcacctcattatattttatcgtcaacctattttatattttaaagaaaaattaagaaacaatgaaacttttttttataaaaaacgactattttaggatttcattcttgtattaaatagagttgtatttattggaaatttaactcataatgaaagtaatttaacagacgaggtgcaaaggatgagaaacgaacgcagaaaaaagaaaaaaactttattactgacaattttaacgataatcggacttcttgtactcggaactggcggctatgcatactacttatggcataaagcagcttcaaccgtggcaagtattcatgaaagcattgataaatctaaaaagagggataaagaggtcagtatcaataaaaaagatcctttttccgtcttaatcatgggtgtggatgaacgcgacggcgataagggccgtgccgatacgctcatttatatgaccgttaacccaaaaacgaatacaaccgacatggtcagcattccgcgtgacacgtatacaaaaattatcggaaaaggcacaatggataaaatcaaccattcatacgctttcggcggcacgcagatgacggtagacactgttgagaacttcctcgatgtcccggttgattattttgtgaaagtgaacatggaaagctttagagacgttgttgatacacttggcggcattacagttaacagcacattcgcgttcagttatgacggttattcgttcggcaaaggagaaatcacgctgaacggaaaagaagcgctcgcttatacccggatgagaaaagaagatccgagaggcgacttcggacgccaggaccgccagcgccaagtcatccaaggtattattaataaaggcgctaatatttcttccatcacgaaattcggagatatgtttaaagttgttgaagataatgtgaaaacgaacttgaccttcgataacatgtgggatatccagtccgattacaaaggtgcgcgaaaacatattaaacagcacgaactaaaaggtacaggcacgaaaatcaatggaatttactactaccaagctgatgaaagcgccctttccgatattacaaaagagctgaaggacagcctcgaaaagtaaaacaaaaagaagcttcgcacaatgtgcaaagcttcttttttatttgcctgtaaatgaatccggttgttctttccggtacccgtaatgaaacagcaattcttccacaatccggcgggaagcctctccatctccatacggattagaagcctgggacattttcttgtactcatcaggatcagttaacagctgttttgccagctgataaatgttttcctcatccgtccctgcaagtttcaacgttcccgcttccactccttcaggccgttccgtcgtatcacgcagaacaagaaccggtttcccgagagatggggcttcctcctgcacgccgcccgaatctgtcaatataaaatgcgatttcgctgcaaagttatggaaatcaatcacctctaaaggttcaatcagatgcactctgtcagaatcaccaaaatgcttctgagccgcttcccggacaacaggattcaggtgcacagggtaaacgacttgtacatcttcaaattcctctacaattctgcggatggccttgaacatgttttccattggctcacccaaattttcccggcggtgagcggtcaagagaatcattttatcctcacccacctgatcgagaacaggatgtgagtaaccatccctaaccgttgtgttgagtgcgtcaatcgctgtattgcccgttacaaaaatagagtcggcctttttgttttcttttaataaattgtctttcgcctggcctgtcggagcaaaatgcaaatcagcaatcgcccctgtcatctgtcgattgagctcttccggaaacggggaatacttattccctgtacggagccccgcctccacatgaccgacagcaatttgatggtaaaaagcggctaggcttccggcaaacgtcgtcgtcgtatcaccatggacaagcacaatatcgggtttgatatctttaaacaactcatccaatcttacaagtgcgttagacgtaatctctgccagtgtctgccgctccttcataatgttcaaatcgaagtcaggcttgatgtgaaacgcatctaacacctgatcgagcatctgtctgtgctgtgcagttaccgttacataggaatctatttcaggatattttttcaattcaagcacaagcggtgccatcttgatcgcttcaggcctggtcccgaaaacggtcatcacttttagttttttcatatttgtcacctggttttctgctatagtaaataaattcatactacatattctacatgaaaatgcatcattttaaatcatttcattcttgattcaaataaaatgatataagttttaatattaaggataaagcttgtttaaaaatggtttatccgatatcataaaaatgtgtaaaaacatattgaaaagggtaaatagagaatagtttaaccataaattttttcgatcataaggaaggtgccttttaaatgaaaaaagtacgtaaagccataatccctgccgcaggtctcggaacgagattcttgccggctacgaaagcaatgccgaaagaaatgcttcctatcgttgataaacctaccattcaatacataattgaagaagctgttgaagccggtattgaagatattattatcgtaacaggaaaaagcaagcgtgcgattgaggatcattttgattactctcctgagcttgaaagaaacctagaagaaaaaggaaaaactgagctgcttgaaaaagtgaaaaaggcttctaacctggctgacattcactatatccgccaaaaagaacctaaaggtctcggacatgctgtctggtgcgcgcgcaactttatcggcgatgagccgtttgcggtactgcttggagacgatattgttcaggctgaaacaccagggttgcgccaattaatggatgaatatgaaaaaacactttcttctattatcggtgttcagcaggtgcctgaagaagaaacacaccgctacggcattattgacccgctgacaagtgaaggccgccgttatcaggtgaaaaacttcgttgaaaaaccgcctaaaggcacagcaccttctaatcttgccatcttaggccgttacgtattcacgcctgagattttcatgtatttagaggagcagcaggttggcgccggcggagaaattcagctcacagacgccattcaaaagctgaatgaaattcaaagagtgtttgcttacgattttgaaggcaagcgttatgatgttggtgaaaagctcggctttatcacaacaactctagaatttgcgatgcaggataaagagcttcgcgatcagctcgttccatttatggaaggtttactaaacaaagaagaaatctaaacataaaggctattggacattcatccaatagcctttttttatttcaacatcaaagtcaatgtatgctcttcattatcaactgcgaagacctgatcaacggcctgccgcaaaaattaataatcccagacaaacacactgattgtagagttaaacaaactaaatgaaaacataaatacaaacatgcagattaaatagtaaatatcttgtattcaatgcaagctaagtaaacaccacttgctaaaagaacaatgactaaacaaccagcattacaaaataattaaataaatttgaagcaattacaacagaaggcagtgaactgtcggaaagttcattttggctaccatattaatcccttttaatttaagagccaggccctcaaattcctctattcggtcggcatgtccaaatatatccatccatcatttttatgatttgcagaaatgttcattatctcaattttcacgtttaacccttcgtcgaagagttaactctatagacttatttttttaaactggtcaaaaaaatcagtgtaataatccattgtataatgcacataaaatttgccccatggatggttttcaaaggaattatagcttttatttttaaataaatctatcgcctcgatatcattgaagctatctaatacatatgcgtcaaatttattccaaatcttattataataatcaacatcaattactttgatgttccctccatttataagcaattttttctgatcttctttatcaaaaaagtgatgaacgtttcttgcactatttaagataattttggttttagggcaatttaatctgacgtagttatagaaaagattaaatttctgtttccatagtgcaaaataattttcaaaatgatcttctatattaaaactttgttttttattttgaattgtaaatttataataattcgttttagggagagtccatctgttatttgtaacaaactggttatctgaaatttctacgtagccaaaatgcacatctgcgaaaaagtccaaaatcaaaatgtctggctgaacagatttaatctcggttagaaagctattctcaaaatccgtctttaaagtgtttttttcatgattagacatgttctcattatcaataacaatgtagttaggtttactcattgttgaaataatggacgattggttttgggtcaatacacaatcaaaaaaatttttataatcagcattaaattgagagttaaagttatcacgtgtaacacaactaccataaacagctacttttttcatttctttattccctctttaatattagttcctagactaataatttgttgataaacacgtttacagttttctttatccgtatacttataaaattgatttactctatcaatatatttggcatccattatacaatcgttttccatacaatttatcagcttatcaactaaagcatctttatcagcaattacttctccaaaccccattgaattgtaatcaaaataccctttttccaagtgatttttttcgtattggaagtaaaaaacaggttttttaagataagcaaagtcaaatgcaacggatgaataatctgtaactaaaatcgcactattattgaaatgatctcgataactttcattaatgtccgcaatcctcactgaactatttttgttgaaatctttcaactgctgaacaatatttggatgcgggaagaatacgatctcgtatcctttttcattagcctcattaatgagtttagcatcatttaataaattattaagttcattaaaataaactgagtttttaaagagtggtgagtaatctcttttccctgtttgcggatttatttttcctactaaatgatttctccatgttggcataattaatatctttttatgattatgattaacaagcttatcaaatctaggaaatccagttagaattacttctctttttgaataattataatgaccattaattatagactcatactcaggttgagcggctgtgataaatagtctaatatttttcttatacttattaagccatcccgaaatatcatctttcgtaattccatgttgaagaaaaacaaagttaaatttaaataagtccttataatatttcctcatattcacaaacgggttgactacataatcatctgcatgtgaagagataatttcatcggcaagtaaatgtaaaaatttgtgcttaggtgacccgtatgcaacaactggtcctatttttttcagcctgttataatctggactatctttactgataataaaatattttttgatgccgtcattctgctgcattgcatattcaaataatgcttcagcattatcatctgccttgttgattctatccataaaaagccatactcttttatttttctttattttatagaggtgttccataatctttcttacatttgatgctttctcagcacctattttattaaaggtcttaaaacgtctttgagcccgcttttcttttgctctaataatctgatttttatcttttagaactactaaattattaagtttatgatcgaaataaatccctataccatttttggtatagaaatcaactatatgtttatccagcgggaataatcgtccaaagttaatttttacttttattagttttccatttgatgaaatcatcatttcaatattcgagttatttgcaagctcaccaactgggatatcaaccttaaagcccaggtactctttaactggcttatttaagcaatataagttgtgtactgttctatcaattttttcggcatgatatatcttgtcattgacacatgctttcacttctaattctgcggcatcaaataatgaaccaaaattaccttcaagggttaaaatccccttttcaatgcttaatagctccattgttatagcttcatatctcatagaattaattaatttctctttaaaatataaattcacattacgattcaaaaagatctttttaaatacattttttttatttcgatatttcaatttgattaaaaaatattttctgtgcaagtttagagatttttgttcaaagattatgtcgtcatctataaatgcaagtattctttctagcaagtcaaaaaactcttcaacttccttatccgtcaaaacatcagttctgtcttctatatttattctccactgcaagtcataggcaatcatatactgaatgtatcttggaacgtatcctaaagttgtaatactatgattaattaattctcgagagaaattcttcaaataatccacataccattttttatcatttttacctgtttgagttgcagatgacgcatcttctcttcgtcgataattatattgtccttctgacacaataccgtatacttggcgcttcattataattttagtcagccattcactatcttcagcgtaggccatatcttcattaaaaaagtgatttttaacagcttcttttttcacgaatgaacttggtgctgataattgaattcctgtatgttctttcaagatatgaactagcctagttttatcaaatttataatttaataagtgtggaccacttgttttaccaaacatcatcattggaatagaaactacatcgactttagaataattcttttcaaaaaaatcatatacttttaaaagggttgaaggggacaatgtatcatcaggatctaagaaattaatatatttacctttggcatattttaaaccctcattacgcgcactacttgctccgccattctccttatcgataaagactatattttctggatacgcttctttatactttaagcaaatttcccctgatgcatcaacacttccatcgttgactaaaatcaactgtatatgatgctcaaaatcaagtgcctgatcaattatgcttgttattgcttcatctaaaaattcttcaacattgtaaattgccattataatagaaaagaaaaaattcttttgttccaagtttttcaatctcctttaatttatttctttttactcaagggtattagattctaatcaacttttgaaatattctagttaaaacattaactttttgaagatcaattaaattgttgtctttttcaacaataaacctaaaaaaagtaactcctatcggaagttttaattgatatgaagaatattttctatccctaactgtggttccccaaataactatgttcttatgttcttgcttgtttattaattttgcttttctcaattttcttccataagagatataaacactatttttatcgttaatcacagactcttcattactcaaacttaccattagctcaattgaaaatttattgactttccatgaagtaataacgattttttcattttctagtttccctaattgaataagtctgttgacaggataaccccatcgtttaaatgaaatgagatactcttttaaatatgttttcatgttttgttttacaattaaattctcatctatatatttcaaaacgtgaaataattccttaaaaaactcactctgttctatcttatttagcacttcataaaccttgttattgtttttttgaaaaataaataattttaaatgattaagaattaaacattgaacataaggtataacttcgctgtactcttctaatgatcttttaaccatttcaccatatccatttgtaagtaaaaaagtatacctgttttttttagaccacgaagtgtctactagagaatcctcactttttctttttctatagaaatatttagcggcaggaataaggccatatttttgttctttaattaaaaacgtattaataaataaaacatcttcccaaaaatccattttttcattaaaagcaagaccaagacgttctattgctttttttcgaaaaaatgttccacctatgtgataatgaatagcagtgtaattatcagttatgtttacaatgctttcaccacttttaaatctataattaagtgagtgttctccatttttattatcgaagaaaaatagcggcagtaccgctaaattaatatcggtatgcttttcaaaaaactttaatacctcagcaatagcatttagtgagactttgtcatcagaatctataaaccctatatatttactattatcacaaacttttaatccattatttcttgccatactgacattcggttcatcttgataaataattttaatattattcggatatgcagttgcgtattgttcacatatgttttttgaattatctatgctattattttcaatcaatattatttctatgtttttttcaaaattaattgtctgatcaataatactgtcaatggcctctcttatatataatcccgaattataaacaggcattacaattgaaaacaacatctcaagtgctcctttaaaataataagtttttatccgagtagtcttccacaactttttttgaatgaatcatcttttccaactaacaaaattggtcataaaatgaagtaatgttttcatcctgtttatagtctcttgttttatgtatggattcaatttacttttatgttgttttaaaaagaggtcccggagcacacttttcaaaatcataataaaaatctcttagtttatctctataaaatttaatatcgggaacataacgcctttttaaaccgacataataagcaaatactgaagaatagtctgttattaatatatctgatattaagtataattctctaatatcattatgatcagaaaaatcataagcaaaacccatgtattcagttaagttaatattttcagatacaagatagtggacccttaaaataacaatatattcattacttaattggtctttaagactttctaaatccaacaccatattaaatttatatttacctttaacataaaatgagttatctctttttattttcagcattccttcattgctattttttttatataaaaaatcgttcctcggatagccctattcaataaacgtctttttaaactgaaacgcatttttaaaaattttcgtagagtaagcattaagggaaatgagataaccgcatttactgacttctataagaaagtttcttttatattattcagtcttcatgccgggcatatgtactttatccatgtcatttgcatttaggggagttccgtgcccagtgtgcacatatgtagtgtttctcggttttagaacctatagcggcaagtggctgtttgttatccaatattttgatgtagccaaatacaacagccatttgagagagattttttcaaataattctcatctgaatcatcaaataaatctttgtctcttttatctacactccaaaatatccatattcatatttattcttattttcctcaagatactcgaaaattgctcttggattacagctgaattgtttgcctgaatagctttcgaagatgagtaatctttcgtttctgggcaaaagcccaattattctaaaaataattgagtatacactgaccaatagtcttctatatttcattaaaatctttgatttcattttagactctttaaatatcaaagaattaaatacttatctcagcaaacaagaaaaaaagaagcaactgaatgattcaagcctcttttagttagtgcgtctataaactagccatgtgttttttgatttggtagttgaaatggcttttgttcttgaaaggtaaactttccagcagcttcatatgtccgtagtgaaataaatcaaatgttccgtacgttatcactttcttcatgagataacatcaccttccaactgagagtaccagaaaaaaaccaaaaactttaacaggttgtttatcatttcgacatattttttacgtaccattaataatgaacaataatagcataagttcctataaaagttaagactctttaaaaatgttaatcaccagcatttttttgtatcaccgttgtattgttgtatattttttgcaggtccaatatcttatctataccctttataacgagttttctttttcggaaaaatcgattcttttgtcgcgtttttaagtgaaacgttttctttctgcaacaccatttattttgtacgcccttctcatattaatacatcgtcaaaacatgaaggaattgtaatacgaatgttaaaagttcctaaagatttttgcggtaagatagagtaaaacacacttgtttttatagacatatagatgaaagaaaggttgatacgatacaaacgaaacctattaattaattagataaagaaaaaaccgagcttcttgagaaagtgaaaaaagcttctaatctggccgacattcactatatcctccaaaaagaacctaaaggtctcggacatgctgtctggttcgcgcccaactttatcggcgatgagccgttcgcagtcctgcttggagacgatattattcaggctgaaacaccagggttgcgccaattaatggatgaatatgaaaaaacactttcttctattatcggtgttcagcaggtgcctgaagaagaaacacaccgctacggcattattgacccgctgacaagtgaaggccgccgttatcaggtgaaaaacttcattgaaaaaccgcctaaagacacagcaccttctaatcttgccatcttaggccgttacgtattcacgcctgagattttcatgtatttagaggagcagcaggttggcgccggcggagaaattcagcttacagacgccattcaaaaactgaatgaaattcaaagagtgtttgcttacgattttgaaggcaagcgttatgatgttggtgaaaagctcggcttcatcacaacaactcttgaatttgcgatgcaggataaagagcttcgcgatcagctcgttccatttatggaaggtttactaaacaaagaagaaatctaaacaaaaaggctattggacattcatccaatagcctttttttatttcaacatcaaagtcagtgtatgctcttcattatcaactgcaaaaacctgatcatctgtattcacaagaaaacgcttcttgctgctgtcatacaatacatcgctatcacttaaggatagtgacgccgggttgataggagaaatgttatgaaaaataagctctgttgctttatcattctccagtacataactgattttttcataatcaaaattcagcgtttttctgccgtcagccttatttccttcagtataaccattcaatttcgattgaatgctggtgctgctgtctcctaggaatttcagaaagtattcataggaagatgctgcgttttgcgagacataagacgtaaatgcagtggcatgcaattcagcgtgtttcatgttagttgcaacagcgctctgtttcacataataagagtgcccgtcaaactttattttcgctgcttgtttgccttttgcagctaccgttacttttgtaccgaatggcagtgtaacgtcagccttctgtttcaaaccctgatccttataagcagccgctttttcatttgctataaacccttgcttattgattgcagttaagcgttcctctgacttgccctttgcatcgccatgatggttcttcacttcattttgcggaatagcgccaaacgaagcaattgtacgaagcggggcattaaagaacatcgttcccgccatgaagacagtcagaatagacaaaatagcaatttgaatggcattggccagtgatttcggctttttcttctttttgcggaaacgggcaaacgcttcaggatcttctttcttcctctcttctgtctgctcttttttatatgtctctttttcttttttcgatagcttattaaaccagtcaataaacgctttgtactctttcacaaccgtttttgtttcatcaaacatacgaagctcgccatagtgcatccaagcaacacggtcacacatcttttcaatctgaccgattgagtggctgacaaagaaaatcgtttttccttgctttttaaactcatttattctgtctacacacttctgataaaacgtttggtcccccacagaaagagcttcgtcaataattaaaatgtcaggatcaatatgcacggagatcgcgaaaccgagacgcgacttcatcccgctggaatagtttttaaccggctgattaataaaatcgccaatctcggcaaattcaacgatgctgtcatacatatcatcaatttctttattggttaaccccatcatcaaacacttgagccggacattgtcccggcccgttaattggttattcaaaccggcagcaatcgcaatcagcgacggctggccgttcatttcaatttcaccgctggtcggcggaataattttagccagcaggttagacatggtcgattttcctgacccgtttattcctacaaagccgattgtctccccttcatacacgtcaaaggagacattccgcacagcaaaaaaaccattatccttagccggaaaaaacaatcctttaatcttgtccgattgttttttatacaaatgatactgctttgaaacatttcgaaacgaaacttttagtttcatcgtaaaatctccttacgtattaaagaaagtcaacaaacttgtctctgaatttcatatgcaggatagaacctactaacaataaaaggaatgtgaacaaccaaaagtacagcgtgtacttcatgtcatggaaaaaccatgctccatctaagaagctgttccggaatccttcaataatatagaatagtggattcaacttcagaacaggcactaattcggggtggctttgaccgagtttcgcattaacatcccaaaaaattggcaacaagaaaaacaaaagtcttgttacggcctgcagcaaaaattgataatctctaatcagcacactgatcgttgagttaaacaaactaaacgaaaacataaaagcaatcatacagatgaagtaataaatatattgtaaccaatgcacactcgggaacacaccattaactaggagtacaatgatataaatcaccatcatgatcatataactaaataagttagatgcaattgccacggacggtagagaactaatcgggaagttcattttagccaccatattaatgcgcttaaatacactatttgatccatcaagtatagttggactgatgaaaaaccatgggattaatcctgccagcatccaaataataaaaggcacttcgcccgctccggttgtcacaggaccgccctttctaatccccataccaaatacgaaccagtaggccagcatttggataagcggatttaagaactgccataagacacctaaataattcatttgatatttagacttggtttcataagccgccaatcttaaaattaaaggaaatgacgttatttgctctctgagtatacgcaacaaatcattcattttttatcttccttagacttaattgtttttgggaatctttctgtttaaaatttgaaagcaccgctgattattgtaacagatcctgcattttttttcacttctcaacaagtatctaaaaagctgccgaaatatcgacagctatacattttataaaataacctaaattattcagctttaaatacagtattaacaaccttttcagatgaacgtcctgactctaaatagcaaaacttatcatagaaaggaccaaaagaaaccggaagcttataatcaggcgatgagatctgcttgatagcctcaatcgtttcttcagtagtttttaccaaaggaccaggagcttctttttcaaaatcaaagtagaaaccacgcaacttatcccggtaggtctcgatgtcagggacaaagaatagcattggccgttttaaatttgcaaaatcaaagaatactgaagaataatcagtaatcagcaaatcagaaaccatatacaattctcgaatatcctcataagcagaaaaatcatatgcaaatccttcaaaaggacctaaatcaaaattctcagctaccagataatgcattcttaagattacgatatattcatttccaagctcttgtctaagttgatgcaaatctaaatcgagatcgaacttataacgcccttttgcataaaactgatcatctctccatgtaggggcatataaaataacctttttatcacgaggaatatttaacctactctttatcaatgatattgtttcctcattattatcattatgaagaaaatcatttctaggatatccagattcaatcattgtcttgttaaactgaaacgcccgtgtaaagatctcagttgaataaccatttggggaaatcaagtaatcccaattagaagcttccttgataaaattccttttatattttttggtgtttgtaccaggcatatggacttcttccatatccattgcaagtctttttaaaggtgtgccatgccatgtttgtaaatatgttgtatgactaggtttcggaatccataatggaagccggctgttaacaacccaatactcagctcttgccatagcgaagagccattttaatgagaggcgattaatgtaaggaattcccttttcatcaaaaggcgctgaatattgtttatttacactccaatacattttatactcagggtggttttcccgcatatattcgtaaatcgctctcggattacaactgtattgtttcccattaaaactttcaaaaatgactgttttccttttaactggcattctgctagccatcatgaatagagatttgtatgttttagtgattaacttgtttctcatttttgtgatcttttttatttttgatactaatctcttcttctttcctttaataaagtatttaatccttgttttcaggctatagtcgtttactctgatacctagagtctgctttttctttttcttaaagacttcataacgaactggtgtgttgtttgttttaataatacttactaatccttttaatttgttttttcgatctcctaaaacaagagcagtgctgttgaactgaatatccgttccttcatcgtcattgcatatatactccataaaaagacgataaacataacgtttttcatttgagaaaggaatttctttcaaaggcactttcacttcaaaatcatacagttccggaacaaaaccatctgctctcatgttttccaggccatgtgtttttctttctagcttgattggaaatttttcctcaataggtgtttctccacccttttttaaaataaggttcaagttttttatccgatattgattttcggaactcaggtaccccgcataacctgttatgcttatttcttcagagctaatctcgatttgatcaaatctgatgattttggcctctcttttcaccttaatagaaaagttgcctttatcagttgtataaggtaaaatcaaaagttctgtggtttgatcgacatgaaaggcgcgctcaattgaatttacttcagcagaaagacgcttcaagagtggttcctgctccgcatcttcatatttttttcgaaattcgacataaaaatcatatgtttgtcccatttcaacaggcataggcaaaacatgagcatttatctcagttttatactctaatgagccagtgttttgaagcggaaattcagattccgttcctgaacgtctctctttcagctttaaaaataactggtaatcctctaaaaattggtgttctgaatcaattgagattaacaattcaagacttcctaaattgtttttcaagcttttcaaaatacatttaatcacagtgttttcaatcattacttttttctgctcctctgtataaaagctctttcctttttgcttccttttattagtgtcaactactaaggacattacccaaaatattaactctcttttatttccgtgaccctccaagagaaattgcctttaactgttgtatagggctctactctatagccattattagtatctatactgtttcctgacaattttgtttcttcactcgaaagtcttcgcattgttttaatatggccatttgcattgaaaacaatataaaaatcaataacttgggttttattagcagctatcttttcaatatttacatctttttcgagatcaattacaaacagttgatcattttgtaagtttgttgaaataatttcagccttattctttctgtccaagcccactaaacgtatttttttaatatcattatgatcaaaattctcaatgtcaatttctattttagttttatcaaaatcctcagtataggaactaatagaaggatctttttttccaacctttttagagaacttctctctttctattcgcacctcaatcatctgattaagagcaaaagcccaattttcaatatagttgggtcttgaatatttttcagccattttaaaagcttgttctgaaaatttttgatgagtactttcatctttcatcaaagagataatagcttgacccaatttctctatattatactgttcaatgacatatccatttgctccgtcagtaactaagctccttgctccgtaatcataatcgtatgttacaactggacatccattgctcagtgcctccatatttgatagaccgaacccttcaaaatgagaggttgaaatggttagccaagctttttgaaactctgagtcagggttatccgtatagcctttcaaaaagacattattctgcagtttggtatcttcaatttctttttttattttttcgaaatcttcacccgatccgaatatatcaagttttgcttcaggaatttctttcacgactaaactaaatgcttttactgcatgtatcagatttttcatagatgcaagtcttgaaataatgacagctttgtatttttcactcggcacattcaatacagcgggatcaagaggcttatcaattgtatgcggagtaaagaaaaacgtctcttgttcccctgaaatcaatttaaaatcttctagctgctcctcagttataaaaaagacagcatccaaattatacatctgactaaatacttctttatagcgacccttaatttgatatttattgctgccgtaatgcttgttatgaataattgctccataataggaagaaggtgattttttcactttaaagacatgtttgtcttgcggtctgctgtccactaaaaacaacttaggtttatcattttgtttttgcagatattctatccaatattgacgcagttccgattcatcttttacttttatctcaccctcaagggagtaccaaataatatgagataattgaacatctttttcttcattgttccatacatagagtttgtctaaatatacttgattttggtcattaatatattcctgcagatacatcttgtttagctgcacatcataatgagtaacgagaactaagtttccgttcttcgtatattcctctctctttatgagctggtttttatcattccaatagtcgacgtaccggatagtttctccatctccgtagtaaattacagacatttcattgttcttcttaccaaacaatctcgacacagtttttgcaaattttcccattccaacttgcttttttatctggtcaaggcctatcctttcttcgtatgatcttttcccatttgttctaacacttaaaaaatcatcgaatagattaataacacttgtgaattttttatcaatcttaccgttgctgtacaattcatcaatttttgaagacaactctaaatcaaaacgaaacgttaagaaaaaggtgttttggttacactcttctccaaataattttgaacgcaataataatgatttcgtcagaccgccataattacttggcagtccaccagagataaaataataatccatgtcaggaatttgttttatattagattcactcaccgcatgtaaagacaattttttactccctttcggcatctagaatatatgatcattgaaatttatatctacccggatactttagtcacaaaaatcaatgtaagcatcaaaaagtacttcttatttcaataagaagtactttaattagatattgaaccaatgatatcaggatcctaaattataaaccagcaatttcctctttgatctttgttgtagagatgccttctgttcttgggaggtaaacaacctcacactgatctttgagaaagtcaaatttaccttcccagtcatcccccataacaaaaacatcaatattatgatcaataatatcttgctttttttgctcccaattcttttcaggaattacttcgtccacatatcgaatggtttctaaaattaatttacggtgctcatagctgtgataagcttttttttgcttttgtaaattgaattcatccgttgaaatagcaacaactaaataatcaccaagctgctttgcacgctcaagcaatttaatgtgaccccaatgcagtaaatcaaaagttccatatgtgataacttttttcatttaaagaaacgctccttcctaatgttaaacactattaaaaacactactgacgttagcgattaaattctaaaaacctgtttgtattccttatatcgacatatttctcgtatgtcttcactgatcattaattatagcataccgcctaaaaaaggttaagtactcatgaggagaaaaacattccaaaatatgtaattacactcagactccattggcaccaaggtctgttgttcattcgttcattcaattgtaaaattggaaacatatttaaatttaatgtaaagataatgttaatcctttgttgaagatttatgttaaaatataaggtagcttgattttgcttttagaaactctcggtttttaactatataaatagaatcttaaaggaaggaggagccagacatgcaaacagagactattcacaatattccttatgttaacagtaacttaacatcatttatcgattacctagagaaacattatattgatcaaaagattggtgctgtcatttccacagtcaaccctgaaattgcatttgcagctattaaagatcgggactactttgatgtactatcttcttcaaacttcattttgcctgatgggatcggtgtagtcatgatgtcacgtttgactaacaacaggcttcagtcccgaatcgcaggttacgatgtttttaaagaacttctgggcgttgctaacaaaaagaaaaaacgcatatttctgtacggtgcgaagaaagatgttataaaaggtgttgtatccaaaatttcttctgaatacccaaacattaaaatcgcaggttattcagacggttatgttcaagatcgcaccctagtggcaaaacaaattgcaagagcaaatcctgacatggtattcgtagctttagggtatcctcatcaagagaaattcattcataactacagacacttgttccctaaagccgtatctataggtctaggaggaagctttgatgtatttagcggtaatgtcaaacgggccccttcctggatgatacgtttaaatttagaatggttctaccggttaatcttgaatccatggcgatggaaaagaatgcttagcatcccaaaatatgctttaacggttttaaaagaagaaaaaaacaaaaaaactttctatccaaagcctgaaaaagatcatacaaaacagatttaaaaacgaaaactttcaaataaatggatgataaaaatgaaaataagatcactactggcgaattgctatttgtattttttatcagcaatcgccttttttctgcaatgggtgaaacctgaaagcaaagtgaccctcctgatctcattcgaagcaaacgcaaaagcgattcttgaggaatatgaacaaggacaatactcttataaacttaacatcctgtatacccagcaggcctctgctattgccgagagcttcccgaatgtagatgcatatttattacaagaaaaaaaccctatccatctcattaaagctgtatacctaatgtttaacagtaaagtgatcataacagataattactttctattaacaagtgtgttaaataagcggaagcaaacgaaatgtatccaagtatggcacgcaaatggctcactcaaaaaatttggtttggaagacattacaaacatgcaacggacgaaaactgatattaaaaggttccaaaaagtatacagttcgtatgattatttaactgttggctcagaagagatggcaaatatcttcaagaaatcatttggaataaaggataaccaattattaaaaataggtgtacctttaacagacccttattaccgagaaaacaagaaaaaaatttcagatactctaaacatacaaagaaaaaaaataatcctctatgcaccgacgtttagagattataatatgcaatcaattcaattgccttttacagaagaacaattaattcatcagttaaaagaagaatatgttttatttgttaagctgcatcccgccattcagaacaatattgatattaaatattccagtgattatattaaagatgtttctaattatgccttgtttgatctactcatggctgcagacatattaatcactgactattcttctgttccctttgaattttcgattttaaataaacccattcttttttatacttatgatttaaaactttatcaacagaagcggggattggttgataattatctttccataatacctggaagagcctgctatgacagtgaatcattaataaatgaaattcaaaccccatttaattattccaaaataaaagttttttccgatagatggaataagtattctgatgggaattcaagccaaaatttattgaatttcatcgaaaatttaataagctaaatgatgacacttgttcaaaacagaacaagtgttcttttttctcttgactaccgaacgtatgtttgctttaatgtaattagttgcttatggcagcaaataataatagaggtggtaaatttatgagaaaaaaagaactgtttgatttcaccaacatcacaccaaaattatttactgaactacgtgtagcagacaaaaccgtacttcaatcattcaatttcgatgagaaaaaccaccaaatttatacaacccaagtcgcaagtggattaggaaaagacaacacccaaagctatcgcataactcgtctatctcttgaaggtttacaattagacagcatgctgttgaaacatggaggtcatggtacaaatattggaattgaaaatcttaatggcaccatttatatttggtctctatacgataaaccaaacgaaacagataaaagtgaattagtttgtttcccatataaagcaggcgcgactttagatgaaaattctaaagaacttcagcgattctcgaatatgcctttcgatcatagggttacacctgctcttgatatgaagaatagacagttggcaattagacaatacgatacaaaaaataataataataaacagtgggtgacaatctttaacctggacgatgcaatagcaaataaaaacaatcctctttatactattaacattcctgacgaacttcattatttacaaggtttctttttagatgacggttatttatattggtatacaggagatacaaacagcaaaagctatccgaatctcataactgtatttgattccgataataaaatagtgctgcaaaaagaaattactgttggcaaagacttgtccaccagatatgagaataacttccgtgaaccggaagggatctgtatgtacaccaatcctgaaactggggcaaaatcattaatggtgggaattacaagtggaaaagaaggaaatcgtataagcagaatttatgcataccattcttatgaaaacttcatgaatcatgtacctatgcttcgatcccctttattaaaaaccgtggggcaccaagatacacctccagaaagatttcaaccatttatgcaaaccttcattttagagtataatgctcaaaacaaaaaatggatggttccgacttcaggttatttaccatcttacacatcaaatttagtccgaaatattactatcaatgcagatggaaacttgcaagtcacattaaatgaacgctatattagtttactgcatcaatcgatagaaggagatttccgcttaaaacaaaaggatatccgaatgggatcctggtattttgctggcggagaaaaatcaaatgtgcttgaaataggttttatgaaagggagtacaaaaatcagacccgatgatgcagccatctcaaatgcttcaagaatgagtatttttatgattgttgcggacaagattgaggtgtgataaacaaataggctgtagctattaaatagctacagcctatttgcaactttctaagttttttatcgatattccggaacatcaaaataaagtgtatagccgtccagcaatgaatacaggctgtacatgcggtttacttgtttgtacgcccagccgatgtctgttgcgtattgatgtgtcgctgtagctgaccatctcattttgtacagtgtgtcctgattgtaagctgtgttgtggatatacgatgagcctatgaatttagctccgccgataatggccgcttcaggtgtgaaccagccctgctcgtacgcatatttggctccgtagtaattcggattgctgtcgtatgctccaattccatacatgttgtatacggtttttccgttataggttaatccattggctaaggcggatgtcccgtttcctgtttcaagaagagcgtgtgagattaaatacagttcgttgatgctatattgattggcggcatcgataaatgcctttgctctccctgtcaggatgcctttacccgcaagcactttctgattgacctcagtaacgctgaggcccgctgtctgtgacagcttgagaaattggaagtagtatttgctgtctctggtaaagttatttggatccacgtattgaactacttcatcactgcttgcgtttcgccagcccaaattgatcttagcccagccgtttatctgtccgatgattttcactttatcgccttttttaaattggccgatcacgtttgtcgggctgacttccggcgttgaccggatatttagtacatcagccgtaacggttgatgttgctatattaatgtacgtgagcgatacgtaagccgctccgtctgtttgcggacttactgtcatttgtttttggaccatatcacgaagcgagagattgtaatttgttttcatgatttgcgggccgtttttgatcttcacgatagatgatgtccatccgtataattgttttagcttcgttgatgccgcagcagctgtatcattgcctgtgaactgctcatttacgctgattttataaagcgtattgcttttcgttgtgtagctgggggttacacttttcgatttaagataggttaacccattattcaatgctgttttgctgctgagctgtgttgtcacgattttgtattgtgtatatgctgtctggcctgtttttgatgttgtgactgcgatatgattttgtttgaaaaatgttaaaacgcggtcaatctcttcttggctgataatagcttcagttgtgatttgatagctgctcgcagctgtctgaccggttttctggcttgctgctgatatatgattcgatttgaaaaacgtgagtgcctgattgactttcgtttgatcaagcagagattcggttgtgattttaaacgtgccagctatttgttttttgacggatttcgcagaagcactcagctgatttttctttaatatgttcaagccctttgtgacttttgcttgatctgatgtttcttctgagatgagctgatattgattttctgctgttgatccagctgctgtttttgcagcttttacttttttctgagcaaagaaggctgctgctttgtttgcttgctgctcgcctaaaatctttgccgtcgtgatttgataagctgcagacgttgtcgtttttttgacgctggatgacgtgtaatgccattttttctttttaaagaaagtgtctattttttggagctgctgttttgttatacccttcatattcacggtatatgatgtgctttttccaacctgttgataactcccggatacgccagtgtttttcttgatttggctgatggcgtcctttactgtactcagccctttgaaataagctgattggacattgtatgactcaacggttgttttttgattgatggacttgtagctgcctgtgatgccagtgctctgtttcagctgctgcaatagagttttggcattggcttcacctgaaatggcggcagttgtaaacgtataataggcttgccctttcactgtttcctttaatgatgcctgcagcccagattccttttggaaggcgtttttgatctgcgctgctctgctgtctcccacgattgtgccagactgaatggttgtgacagacaccgtgtgtgtgatgggctgatacgagcttttaatccccgtttgcttggccaggctctggataagcgccttgacttttgtctcatcagcaatgtctgatgtcatgacgttcatatagggctgagctgctccgtaagcttttacagcgccagccactcccgtctcctgtttcagctttgctaggatagtgttggcctgtttttctccggagatggcacctgacgagatggtgacatatggctgtttgcttccaacaggacttgacgttcctgtaatcgatgtctgtttggcgagtccgctcagtattgctttcgcttctgattcgctatgaatgcctgaggcggaaatttggtaggtcgttgttgtgcctgaagcctgataggatgcatcccagccagtatctttttccagtttggcgacagcttgtgaggcttggctttctgtactgaacgtattcgacggctctactttatatagtgagtagtcggtatacgcggctgcctgggcagaaccagacatggcaaaaaaggcaagggacgcggcggatagaagcataggtgcgattagtctctttttcattccttctcctctttcttattctatgagtatataaaactagtttatttatcggcacgcggttgcttcatttataggtgaatcacttccattttctaataaaaaaaaaacttaatctcgaagtgagattaagtctaaatatgagacacgataagggtacaaggtccttttatcgtaaaatcgggcatttgagccggcaaaataaagtgatcgccttttttgagcggacatgttttgtcctcatacatgagcaaaccgcttccttctatcacgctgcaaatcagaaaggattcatcctgagccatttcagcttcgccattgatgtcccatttataaaccgaaaaatattccccttggacaaatgttttaatggttattccttttctagattctgtcgattcatctatatacccgtccacatggggaaccgtggccgcattgaccgctttcgcaaaatgaagctctctcggacttccgttgctatcaagacggtcataatcgtacacccggtatgtggcatctgaattttgctgagtctctaaaacaagggcccccttgcacaatgcatgcagcgttccgctcggcacataataaaaatcacccggtttaattttgattcttcgcagcaggccctcccagtcaccgctgttgatcattgtgacaagttcggtttttgagcgggccgtatgcccgtaaatgatttctgcgttttccttacagtcgataatgtaccagcattccgtcttgccgagttctccctcttcgttttctccggcatagtaatcatcagggtgaactttaattgacgtatcttccttcacatccagcagctttgtcagaagcgggaaccgatccccctctacgccgccgaatacttcacggtgttcttcccaaagctcgatcaatgtctttcctttatacgggccatttgcaacagtgctcggtccttttggatgagcggaaatggcccagcattcccccgttgattctgaaggaatactgtatccaaatctatctcgtaaagcggttccgccccagattttttctttaaacacaggcgttagaaaaatcggtgattgcgtcatgatccgtacccctcccctgtaaataactgatcatcattttcccggtgcgcccctcttacaaacgcccgtataagctgtcttttttccgatgacaacatatgtacaaagcatcatcttttcattaccccttcaaagaaaacgcttcctatctattatatcacgtcgaaaagaagctttgtttcagccttttcctcgataagaataattctccttttttgatacaaattaataaaaaccgtcaatctgtttacgaaggagagaaactatgcaaatcgactctgatctccagaacaatttagacaaactgaaaaaaacattgggacaaaacgacgatatgatgttttatacatttgctttcggagatagcagacaaaaggcgtgtttactgtatattgacggtctgacagagaataaaatgctggcgcaatacgtcatttctcctttacaaaaagaggcgttagcccataaggaatgctcgattgaagacttatccgccttttttttcggctttcaccacagcgttgtttctacaatgaaagaaatagagcagctcgttttttcagggcaagccattttgctcgctgatggctatcgcggaggattagctttcgacaccaagtcagtcgcaacacgcagtcttgatgaaccctcctccgaagtcgtggaacgcggccctaaaataggatttattgaaaaactgcggacaaacacggcgcttttgcgtgaacggacgagtgatcctaatctcgtcatcaaagaaatgacactcggaaaaaggaccaaaaagaaaatcgctgtcgcttatattcaggatatcgccccagattatgtcgtcaaagaagtgtttaaaaggctgaaatcagtcaatatagataatttgccggaatcggggacgcttgaacagctgattgaagacgaaccattttcaattttccccacaatattaagcacagaacgaccggaccgggtcgaaagttctctattagaagggcgagtgtccatattagtggatggtacgccgtttgctttgattgtaccggctacggttgacgaatttattcattcgcccgatgattacagccagcgctggatcccaatgtcacttgtacgccttcttcgttattccagcatcctgatcaccatttatttgcccggtctgtatatttctctcgtttcttttcacaccgggctattgccgactagaatggccatttccattgcaggcagcaggcttaacgtaccattcccgccttttgtagaggcctttatcatgatctttacgatcgaattgattcgagaagccggattaagattgcctaagccgattggacagacaattggccttatcggcggcgttgtcatcggacaggcagctgttcaggcgcaaattgtcagtgcgcttatggtcattgtcgtttctgtcacagcactggcatcctttaccgttccttcatacgcctataactttccgctgcggatcattcggatcggggttatgataagtgcaacagcgcttggcatgtatggcgttataatggtttatctgtttgtgatcggccatctcatgcgcctgaaaagctttggacaggattacattatcccgatcatggcgcagcctggacaggatttgaaagacacagtcatccgtattcccacgatgtttttaaaaagaagaccgacacgaaacgatcccgaagataacatcagacaaaggtgatggctatgaggaaatcagagcataaactgacatttatgcagacgctcattatgatcagcagcacattgattggtgccggggtgctgacccttccccgctcagccgccgaaaccggcagtccgagcggatggctaatgatactgctccagggcgttatttttattatcatcgctctgctttttttgccttttcttcaaaaaaacagcggaaaaactctttttaagctcaacagcattgtagctggaacattcatcggctttctattgaatttatatatctgtctatatttcattgggattgtttgctttcaagctcggattttgggagaggttgtcggattctttttgttgaaaaatacgccaatggcagttgtggtgtttatatttcttgcagttgccatctatcatgtaggcggaggcgtttattcaattgcaaaagtatacgcttatatttttcctataacccttattatttttatgatgcttctgatgttcagctttcgcttgttccagcttgattttatccggccggtatttgaaggaggctatcaaagctttttctctttattcccaaaaacattattatatttctccggatttgaaatcattttttacctggtcccctttatgagagatccaaagcaagtgaaaaaggctgttgctctgggcatcgcgacttccacattgttctacagcattactttgctcattgtgattggctgtatgactgtggctgaggcaaaaacggtgacatggccgaccatttcccttattcacgcattagaggttccgggtatttttattgaacgatttgatttgttcttacagctgacctggacagtccagcaatttgcctgtatgctcggatcctttaaaggcgcccatatcgggttaacggaaatctttcatctgaaaaataaaaacaatgcatggctgctgactgcaatgctggctgcgacgtttttcataacgatgtatcccaaggacttgaatgacgtgttttattacgggacgcttcttggatatgctttcttaattgtgattacaattccattcttcgtctggtttttaagctggatacagaaaaaattagggagggggcagctacaatgaaaacagcaacaaaattctccgtcatgttttttatgctgctggtcctctgcgggtgctgggatgtcaaagatatcgagcaactatccttcgccagagggctggcgatcgatgagacagatgatcaccagtacaaactgacgtatcaaaaccttcttccccaaagcgaagacagccaagcatccggaaaacccgaatttgtcaatgtgacgtcccacgggaaaacgattctggaagcagtcagtgatgtatccatcaaggaccctcctgtttatagcgatcatttaaaagtcattcttctgggagaaaaactgatgaggaatcaaaatgtagaccaagtcctcaaccactttatccgagatgatgagctgcggcgaagcagctatttgatggcagccagagggaatgcagctgatgttctcacaaaaggaaaccccaatcagcagcagccgatgccctccgaaaaactgattgatttgacaactcacagcggatataacggtaagattatgataccgctgcgcatcggaagagcttctgtctactctcagaacgggtacagttatcttattcaagccgtgaaaaacgaaaagggaaaagccaagtatgacggagcaggcattatcaaaaggggcagcaataaactcgttgggtttctttcagctgatgaaacccaaacactgtcatgggtcatggggacgatccaaggcggtgtcatgccgacgacagataaaggacatccgattacgtttgaaatcaaaaagtcgaaaaccaaaattaagcctatcattgaaaacggaaagcctatctttcatatttctgttaaaacgaagggcatcctgacagaagaccaaaacccgaatgaaaactcctttagcaaaagttatttgcacaggctggaaaacatttttgaaaaaaagcttgaacgagatgtaaagcaggtaatggataaactgcagcacgagtataaaaccgatccggtctttttatcagaccacataaggattcaacaccctgactactggaataaagtaaaagggcattgggatgaaatattttctgagactgattttaagtacgatatttcttttaaaatcattaactttggcacggtgggaaagtaagcaatcaaaagggtgcgcatgatcgcgcacccttttttatgttccgacagtctgctgttttccggccgatcctccctgtccgtttttgtcccgtaaatcctgctcaatttcttcaaggctttttccctttgtctctgtcactttaaatcggacaaataagaacgccatgataccgatcgcggcataaatcaggaataaataactgattccgatcgcttccattaatattggataggttaatgaaacaatcagtgtcccaacgtgcaacattaaggtcgaaacaccggtcccgattcctctgacgtgaagcgggaacaattcaggaagcatcacccacacaaccggtccccagctgaccgcaaagacaacgataaacacgcctaaacaaatgacggtcgtccatgaggcagccggagtgttatcgaaaaagagatttactaaagcgagaacgatcaagctgatcaccatgcccgcattcccgaatagcagtaacggctttcttccaatcttgtcgataattttaatcgctactaatgtcatgagaacattgactgtgccgattccgaccgtgcctaaaatcgaagcggagtttccgaatccgacgtttgtaaaggtctttggcgcatagtagatgatcgtattcgttccgataaattgctgcaaaaaagcgagtcccaaacctgcaataagcgctgggcgcacccatggatcgaacagctccttcaggccgccttcatcctgcttttccgcttcttttatatcatgtatttcctgatcaatatcttttgtgccacgcaatttttcaagaatgttcttcgctttgctttcttcgccattcgtgaacagccagcgcgggctctccggcataaacaaaatgccaataagcaagagcaatgacggcacagcagccaatccaagcatccagcgccacgcttcggcatcggcaaatatgtaattgacaatgtaagaaagaaggatgccgaccgtgatcatcagctgattcagtgatgacagcgccccgcgtttatgttttggcgccagttcagataaataaaggggcacgattgtcgtcgatgttccgactgcaagtcccaaaatgatgcgaaacagcaccatgactcctgtatttggggccagtgccacaccaagaccgcctatacaaaacagcagcgcggctgccataattgctttttttcttccgaaacggtcagtcagcttgccggccgctcctgagcccaatatcgccccaaccagcaaggagctgacaacaagaccttctgtaaacgcgtttaagcctaactcctttttcataaataaaatagctccggaaatcactccggtatcatagccatataacgcgcctccaagagctccgaaaaaataaagccatatatttgactgctttttcataaagatgactccctttctccatcagctgcaatgacattgtctgtgggatttttttagaaatcttttagcctctttttccggccattaaacctttttattttgctgatcataagttttccaatcatttacttgtatttttttcaatgtcgccgaaacattttacctgctgcggcgtccaatataaggtgattcagtacatcatcgttatcaattttcaaaaacaagaacttataaatataggaatatttatcgaaaaatgtctttcgagtagttgccccatggcaaatagaatggtacgcttcaaatattaaagaaacgtgaggtattgatatatggaagaacgatcacagcgcagaaagaaaaaaagaaaactaaaaaaatgggtgaaagttgttgccggattaatggcttttttaatcattgcggcaggctctgtcggcgcctatgcttttgtaaagctgaacaatgcttctaaggaagctcacgtcagccttgcacgcggagaacaatctgtaaaacggatcaaagaatttgatcctggaaaagattctttttctgtattgctcttaggaattgatgccagggagaaaaacggcgagaccgtcgatcaggcaagaagtgacgcgaatgtgctggttacatttaatcggaaagaaaaaacagctaaaatgctgagcattccgcgtgacgcctatgtaaacatcccaggccacgggtatgataaattcacacatgctcacgcttacggcggcgttgacttaactgtgaaaacagttgaagaaatgctggatattccagtcgattatgtcgtagaaagcaatttcacggcttttgaagacgtcgtaaacgagttaaatggcgtcaaagtaactgtaaaaagcgataaagtcattcagcaaatcaaaaaagatacaaaaggtaaagtcgttcttcaaaaaggaacacatacgcttgatggggaagaagcgctcgcttacgtaagaacacgtaaagcggacagtgaccttttacggggacaaagacaaatggaagtgctgagcgccattatagataaatcaaaatcattaagctcaattccggcttatgatgatattgtggatacgatggggcaaaatttaaaaatgaacttatcccttaaagatgccatcggcctgttcccgttcatcacttcattgaaatcagttgagtctattcagctgacgggttatgattatgaacctgccggagtctattatttcaaattgaatcagcaaaagctgcaggaagttaaaaaagagctgcaaaacgatttaggtgtataatgaacgggatggcgattacgccatcccgttttacatatttccttgttgaaaattatcaaagtaacgtttagccttaatttatatggattatgtttcacaggcaagctgaacatactacacgaagcagcttcatttttaaggaggttcccctacatatgaaatgtattgcgattgatctagacggaacattactgaataaagaaagcgtcatttctgcggaaaacagagaggcgatcaagcgggccgttgatgccggcatcctcgtcaccatttgcacgggaagagcgacatttgatgtaaaagcgctgctggatgacttggacatccctatcattgcagctaatggcggtacgatccacgacacgggttaccgtttgatcagccggacattaatggatcaggaagccggtaaagcgattgctgattacttactttcaaaaaacatttactttgaggtatatacagatgaccatctgctttctccttttgacggcgaagctaagctgcacgcggagcttgacattctaaagagcgcaaacccaaacgagcagacggatgaattgtggcagggagccatgactcaattcaaacagtttggcattaaaccaatccctcatatcgaatcggtttttgacggcggtgaaaacatttataagcttctttgcttctcctttgatatggacaagctgaaacaagcgaaggaagaactgaagcatcataaaaaactggcgcaaacctcttcaggaaaacatattatcgaaatcctgccggcctcgtcaggaaaaggacgcgcgttaacaaagctggctgacctatacggaattgaaacacaggatatctatgcgatcggcgatagtccaaacgatttgtccatgtttgaagtcgccggacaccgaatcgccatggaaaatgcgattgatgaattaaaagaaaaaagcacctttgtcacaaaaagcaatgacgaaaatggtgtggcctactttatagaccagcttctttcaggacaatatgcataaagaaaagactccagagattggagtctttttcttttattgcacccgtatacttcctgcgtatttatccttccaatatgtgctcgtgttcatattggtgatggtcacgccgtttgataatgtaacgtgaacaacttgtccgtttccgatatagatggagggatttaagcttgttgattgaaagaacacaatgtctcccggcttcaggtccgccttctcaatcttagttccggcattgtactggcttattgcgtatcgaggcagggaaataccggctgctttctggtagacatattggacaaatccagctgtatcaaatcctgtctcaggtgttactccgccctgtttgtaaggcacttctccgacataaagcgtcgcttcggaaacaatcggattttctttcgggattgtcaggttgtcaaatcggcgaatacccgtcatcttcgatttccagtaatcctctgacaaataggaaatggttactttttctgaccggcttgcctgaatgaacctgcctgcgcccgcataaatgcctgcatgtgaaattcccgttttatacgtattgctgaaatagacgacatcaccaggctttatgttctgaggggctaccttctcgcccactgcccactgctgttcggctgatcgcggcagataaatgccgagtgcctgttgaaacacatattgcacaagccccgagcaatcaaagccctctgacggcgtgcttccgccaaacacatatgggacaccgatatatttttcggcctcctgaacgacaggaacatcagccgttgccggatcggcagcgattcgtctcgccccgatataagttccgctccaatagctgctttttttgtaattggtgatgataaccccttttgactgtgtactgtgaaccatttggccgtctccgatataaagggcgtcatgtgtcggaacagtgccggtgcttccctctttcttgaaaaacaaaatatcacccggcttcaggttttccggctttacagctgttccgattttatactggtcgtttacagatctcggcagatgaatatcagccttactgaacacatattgtatcaatcctgatggatcgaaaccctcttttggcgtttccccgccatatttatactgatatccaagcaggttttttgcttcactgacaatcaattctgatgatgtatcagcttccgcaatctccgcttttgtcataattggaaccaaaaaacaaatgataaccgccacaagcaaaaacttcttccagtttgccagtgtgttcacttttattatctcctcctctttttgcagttttaacatcggtatttttttgaatatgttaagagactttttaatatttttacagaatgaatatgctgggcaaataaaaagagagtgtctcctcagacactctcttttttgaattatttattggcgtttaccggttcttcctgctgctggattttattcatttccatatcaatcttctgtttttcctgatctgtcagctgatcattgaatttaaaagctgacataaacatgaacacgatggctacggcaacaaacggccagatggctttgacaaatttcatctttatcactccgtttatttagattttagtttgtcactatgatcaatatcaaacgtcagttttccgtcttctactttccaagcgaaattagagtctttcgtcagttcgcgaataatggttttctgtttaaggctgtcttttttcacaggtgcaggtgtcgcttcatggatatcgatcggtgtcacttcaaagcggcctgttccatttttcttcaggtgatactgaaccagtgcactgtctcttgttctcgtccagccttggtcaaagacaaagttgccgaggctgtagaaaatgacggttccgttatatacttcaatcggttctaagacgtgcggatgatggccgacgatgatgtcagctcccgcatcagacatggctcttgcaagctggcgctggcggtcgtttggatcattgtcatactcttggccccagtgtgactgcacaacaacgatgtccgcatgttttttcgcttctgaaatcatagggatgaagatttcaggatctgcgggcagcacgcccggcgtattctttttagccgcgaaacctttcccggacacatcggtaaagccaagcgttgcaattgttaccccgttgactttctggtacgaaattttctttttcgcatcacttaagctgtatcccgctccaacgatatcaaggttttgcttcgcaaattctccaagcgtatctttcatgccctgaacgccgtaatccattgcgtggttgtttgcgctgttgagaactgtgaaattcatgtccttcaagactttcactgattccttattcgtctgcagatgaatctctttatctgcttgtttataattcttttgataggttaccgggttttcaaagtttcctgctacataatccgaagctctaaagatcggttcaacatattgaaaaatactgtctgcccctttttgctccgttactttttcaacatagcgtcccatcataatatcgcctacaaatgaggctgaaagtacgtcgtcagaatacgttttgaccttcggcgtttccgcttttcccgcccacatgaaagcgaacataaggacaaaaacgatcggaatggcaataaatacgtgcttattggttttctttttttgctgttttgtcagctttagcagcttttcatgaaagctcagttcttttttcatcgtttgacacaccttacattaaattaagtagtaaacaaacatgatagcaaaggtcgctccgctcaatagcagcgtgcttccgaacgtaatggttaaaccttgtttctgaatggtattggcaattaaacctggcacgatgatgccgattcctcgaaattctgcgatttcaaatggtacaatcgggtatagaaaatcaaacgcgatttttaggacgatccctgttatcagcatggcagcgaattttctgcgtccgtacaaaatcataaatttggataaaccgtatttcacgataacataagtgagcaagctcactagcaaaacaagtaaaataaagaccggctgattaaacacaagtcctaaatatcccggtacaacaagtcctgccggcacgatccctgttttttccgcaaaaattaaactgagtagtacacctaaaattagtgcgatgtataaatctgatccgaacatgtttgcatttccccctagcttacgagctgcttaaccttgtattcgtggattttttcaattaaaggctctgcggcaccatgaatattgccgacgccatatatgacacggttgtgcattcttttctttaacaattccataatttcatctgttgacttatactctagatcatgcagtttgtctgcaggaattttgccttcttcgtaggcttttacgaccggttctgttgtttcaccgattaagatcagttcacttgcttcaatataaggcaatacgtcatttgcgaattgctgtgtccgatcgacacggtctgcgcggcagttcatgatgatgatcggatcatcggtcgggtaaccgatttcttttacacgtttccatatattcaaagtagaagaagcgtcgtttgcggcaaacccattaacaaagtgcccaggctcgctcggactgatcagcggaagaattctcattgctcccggatctggcggcgcattcagcattcccttaaatgctgtttcttcgtcaatgccgagtgcttgagccacacccagcgccagagaagcgttatcagggaataccatgtattcaaatttacgtaaatactcatctgtaatttttgagttatcagcaatgatgacttttgtgtttcgttcttttgctttttgtttaaagaactcggtatattcactatctgtaatgacaagatggccattataaggaattgtagcagtaaacgcttctgcaatttcatcaagcgtcggccccatgacatccatatggtcttccaaaacattcacaatgacgccgatattggcctgcagaagttcttcctgaaagatgatttgataatctgggttaacagccatgcattcactgacaatcgcgttagcccctctttctactgtttctctcatgacttctttttgctctccgatattcggcccctgaggtttccgtttaatcggcttttcctccggtgtgtcccagtaaatcattcttgcatctgttcctgttgtttttccaacagtcttgtaaccggcttctattaatattccggttgtcagccttgtcacagtcgattttccgcggatgccgttaatattcacccgaacagggagggcatcaatgtttttctgatgtcgtcgtttttctaatattccgatgaccagtatgacagcacaggctataatgagtaaccacattgcttttcgacatctccttctatattgttgtaaattcattcatcagtatatagaatcactatgaattctcaatcggcattatgtaacataatcttccctaatcgactaagccaaacttctcttttgaaagagattttatacctacaaactgttttctatttttggaaaacagcaggacttataccttatcacttttttaaaaaattgaagagaatgcgctttcatttttctcctgatatccttctggacgtatagtcacaccctgctgtttgtatttaatatgcatttcaaatcaatctttttttcagcctgtgttatcaagcatttcctgctatcatgcgtgtttccggttcttatgaacacaaaataattttatcctgtttcttaaggacaaggtcataatgtcatcctttctgcatggaataagcaatatgaggcccattccaaaatgactaaggaggttcgagatgaaaacgctaaacatacgagtccgaattctctaacataattaaacattttctgggatgatagtcttttctgtttctcaccatttacaggtctaaacgcatgactttgaaacaattttaataaaacttaatatttgttcaagaaatcttcatccatatttgtgaagactttgtcaaaaaaagagtgaaaaccttaaatttttcaattatatatacaatttacaagtagatttcttttgatatttttattgctaacttcggattgttcatgataatctatatatgtaaacggttacataaacaaggaggagctgttttggctacaattaaagatgtcgccggagcggcgggcgtttcagttgcgacggtttcccgcgtcctgaatgataatggctatgtacacgaagaaacgcgaacgcgtgtcatagcggcgatggcgaagctgaactattacccgaatgaagtcgccagatctctatataaaagagaatcccgactgatcggacttttgctcccggatatcacaaaccctttcttcccccagcttgcccgcggtgcggaggatgaattgaaccgggaaggctatcgtcttattttcggcaacagtgacgaggaattgaaaaaagaacttgaataccttcaaacctttaagcaaaatcatgtcgcaggcattattgccgcaacaaattacccggatctcgaggaatacagcggcatgaattatccagttgtttttctggacagaacactggaaggggctccttctgtgtccagtgacggctatacaggaggaaagttagccgcccaggctatcattcacggaaaaagccagcgcattacgctcttgagaggacccgctcacctgccgaccgctcaagaccgctttaacggcgctttggaaatcttaaagcaggctgaagttgattttcaggtcattgagacggcttcattttcaattaaagatgcacaatcaatggcgaaggagctgtttgccgcttatccagcgacagatggtgtgatcgcgagtaatgatattcaagccgctgccgttttacatgaagcattgcggcgcggaaaaaatgtgccggaggacattcaaattatcggctatgatgacattccgcaaagcggacttctgttcccgccactttctacaattaaacagcccgcatatgatatggggaaagaagctgccaaactgcttttgggtatcatcaaaaaacagccgctggcagaaacggcaattcaaatgcctgtcacctatataggaagaaagacgacaagaaaggaagattaagatgcgtaatatttgtgtgattggtagctgttctatggatttagtggtcacctcggacaaacgcccaaaagccggtgaaacggttcttggcacgtcatttcagactgtgccgggcggcaaaggagcaaatcaggccgttgccgcagccagacttggggcgcaagtgtttatggtcggcaaagttggagacgatcattatggaacagctattttgaataatctcaaagctaacggcgttcgcactgattatatggaaccggttacacatacggaaagcggaaccgctcatattgtgcttgctgaaggcgacaacagcattgtcgttgtcaaaggcgcgaacgatgacatcaccccagcgtatgcgttaaacgcgctcgaacagattgaaaaggtcgatatggtgctgattcagcaggaaatcccagaagaaacggttgatgaggtgtgcaaatactgccattctcacgatatcccgatcatactaaacccagcaccggcccgcccgctcaagcaggaaacaattgatcacgctacctatctgacgccgaatgaacacgaggcttcgattttattccctgatcttaccatttccgaagctctggcgctttatccggcaaagctctttattacggaaggaaaacaaggcgtccgctattcggctggcagcaaagaggtgctcatcccgtccttccctgtagaacccgttgatacaaccggagccggtgatacgtttaacgcagcatttgccgtggccctggctgagggaaaagacattgaagccgcattgcggtttgccaatcgtgccgcttccctttctgtctgctccttcggggcccaaggcggaatgccgacaagaaatgaagtagaggagctgctttcatgaaaaaacacggtatactgaacagccatcttgccaagattttagcagaccttggccacactgataaaattgtcatcgcggatgccggactgccggttcctgacggcgttttgaaaattgatctttcactgaagccgggtcttccggctttccaagatacagcggcagtgctcgctgatgagatggtcatcgaaaaagtcattgctgcagctgaaataaaagcatccaatcaggagaatgcgaaatttctagaaaatcttttctctgaacaagagattgaatacctttctcacgaggagtttaagctgctgacaaaagacgcaaaggcagtcataagaacaggagaatccacaccatatgccaactgcatcctgcaggcaggtgtacttttctagaaaggaggatgaaacatgcagattgaaatgaaagacattcataaagcattcggaaaaaatcaggtgctgtcaggcgtttcctttcagctcatgcctggcgaggttcacgcattaatgggagaaaacggcgccggcaagtccacgcttatgaacattttgacaggcctgcacaaatcggatcatggtcaaatcagcataaacggaaacgaaacgtatttttccaatccaaaagaagcggaacagcatggaatagcctttatccatcaggaactgaatatctggccggaaatgaccgttcttgagaatctatttatcggtaaggagatatcctccaagctgggcgttttacaaacaagaaaaatgaaagcgctagcaaaagaacaatttgacaaactctccgtctctctttctcttgatcaagaagccggcgaatgttccgtcggacagcagcaaatgatcgaaatcgcaaaagcgcttatgacaaatgccgaggtaatcattatggatgaaccgaccgcagcgttgactgaacgtgaaatcagcaagctctttgaggtcattacagcgttaaaaaagaacggcgtctccattgtctatatttcgcatcgcatggaagaaatttttgcgatttgcgacagaattaccatcatgcgtgacggaaaaacggtagatacaacaaacatctcagaaactgattttgatgaagtcgtcaaaaaaatggtcggacgggagctgactgaacgatatccaaaacgcactccttctctcggtgacaaagtattcgaggtgaaaaatgcctccgtaaaagggagttttgaggatgtcagcttttatgttcgttccggtgagatcgtcggtgtttcaggattaatgggagccggccggacagaaatgatgagagcgctgttcggcgttgacaggctggacacgggtgagatatggatcgctgggaaaaaaacggctattaagaacccgcaggaagccgtgaaaaaaggtctcggctttattacagagaatcgcaaggatgaagggcttctgctcgacacctcaatccgcgaaaatattgccctgcccaatctgtccagcttctcaccaaagggtctcattgatcataagcgggaggctgaatttgtcgatctgttaatcaaacgcctcactatcaaaacagcatcaccggaaacgcacgcacgccatttatcaggaggaaaccagcaaaaagtggtgatagccaagtggatcggcatcggaccgaaaatgcttatcttggatgagccaaccagaggtgtggatgttggcgccaaacgagagatttatacgctgatgaatgagctgaccgaacgcggcgtcgctatcatcatggtgtcatcagagctgcctgaaattctgggaatgagcgatcggattatcgttgtccatgaaggcagaatcagcggagaaatccatgcgcgagaagcaacacaagaacgaattatgacacttgccacgggagggcggtaatatgaaaacggaacaactgcaaacagaacaaaaacggattcacttcgacggagtcatgcaaaaactcggcccgtttcttggtttatttattctcgttatcattgtatctattttaaatcccagctttcttgaaccgctgaatattttaaacctgcttcgccaggtcgccattaacggattaatcgcgttcgggatgacctttgtcattttgacaggcggcattgatctttctgttggcgctattcttgccctgtccagtgctttagttgcggggatgattgtgtccggtgtcgatccggttctcgcgatcatccttggctgtatcattggtgccgtactaggcatgatcaacggattattgattactaaaggaaaaatggcgccctttatcgccacgcttgcgaccatgactgtgtttcgcggactgacgctagtgtatacagatggaaatccgattaccggacttggcacaaactacgcttttcagatgttcggacgcggttactttttaggcattcctgtaccggcaattacgatggttcttgcctttgtcatcctttgggtgcttcttcataaaacaccattcggacgccgaacgtacgctatcggcggcaacgaaaaagccgcgctcatttcaggcatcaaagtgacgcgcgtgaaagtgatgatctattctttagccgggcttttatccgctcttggaggtgccatattgacttcccgcctgcattcggcccagccgactgcgggagaatcgtacgaacttgatgctatcgcggcagtcgtcttaggagggacaagtctttctggcggccgcggacgcattgtcggcactttgatcggggtcctgatcatcggcacacttaataacgggcttaatctgcttggcgtttcatcattttaccagctggttgtcaaagggattgttatcttaattgcggtattattagaccgcaagaagtcagcttaggagggttttcacatgaaaaaggctgtatccgtcattttaacgttatcattatttttgttaactgcctgttcgcttgagcctccccaatgggcaaagccgtcaaactcggggaacaaaaaggaattcaccattggcttgtccgtctcaacacttaataatcctttttttgtctcattaaaaaagggtatcgaaaaagaagctaaaaaacggggaatgaaagtcatcattgttgatgcacaaaatgattcatcgaaacagacgagtgacgtggaagatttaattcagcaaggtgttgatgcattattaatcaacccgactgattcttcggcgatctcaacggcagtagaatctgcaaacgcagtcggtgtgcccgtcgtaacaatcgatcgatctgccgaacaaggaaaagttgaaaccctcgttgcttccgataatgtaaaaggcggtgaaatggccgcgacgtttattgccgacaaacttggaaaaggagcaaaggtggcagagcttgaaggcgtccccggcgcatctgccacacgggaacgcggctcaggattccataacatcgcagaccaaaagctccaagttgtcacaaaacaatcagctgactttgaccgcacgaaaggcctgactgtcatggaaaacctgctgcagggacatcctgatatccaagctgtttttgctcacaacgatgaaatggcgctcggtgctctcgaggcaattaacagctcggggaaagacatattggtgatcggttttgacggcaataaagatgcgctcgcttccattaaaaacggaaagctgtcagccaccgtcgctcagcagcctgaattaatcggtaaattggctacagaagcagcagatgatattttgcacgggaaaaaagtgcaaaaaacaatatccgcgcctctcaaactagaaacacaaaaataattgtctgatgtttaggaacctgcgataacgtgaatagagatatagaatgaattatttctcttacgtgaggagaggaacggcatgaacaaaccaacaaaactattttcaacattagcacttgcggctggaatgactgcggcggctgctggcggcgctggcacgatccatgctcaacagccagaaacaacggtaagcattgatgatttatacagttatccgattgattcttatttggtatcagcagaggctctaaatgtcagaacgaaggcttccgcatcaagccaaaaagccgatacgctgcacttaggagatagcctaaagctgatttccttctcaaatgctgactgggcaaaggttcagtataaaaatggaaaaacaggatttgtatccactcattacattgttaaagcagcgacaacggtaaaaaccaaaacaaaaacaaaagtatatacatccgctgacggaaagagcattaagactcttccagcagacacaagcgtttcttttttaggctggagtaaaacgaataaaggcggttttgattttgattgggtattcgttgattacggcggtgcgacaggttatatgaaaacaaaggatttacacatgacaaaataactgagagggattccgcatttatgcggaatcccttttattatgaattgatttgtcacattcccaagatatttctcaggaaatattgtcgtatgctgtgtcgaaaccttacatgatcatcaacatttttgttcacgctaaaaagcggaggtgtaaatatggatcaatttgaagcagcatatgaatcgtataaagcccggcaaacaactgtcgatcaagaaaatgttccatctggaaaagaagaaattattgcggttagaagaaatgaggaagacaatattatcgcagtgaaaaccaatacaggaagagagctcgactatcctactgcgctgtcagaagcaaaatcaggaaaactcgctcatgttgatgtcttccataaatacgggcgtgacattttgcgaagtgaaccggacggcatcaaggaaaataatctgtctgagctgccggatttttaaacaaatacagccctgccgtatgttcgacagggctttcttttaaacaaaaggctgctgaatgtattcggctaaccgttttgcactgtgtgaaatatcctctgcagctgcataattcacgccatagaacacatatggaggcagatacttcatgccgatcagattactcgtggcctgaaatggtttcaatagctcactgatcgagtaatgatttgctccgcccgcttgatatttttccgcttcgctccctgttgatacagccagcatcagctccttgccatgcaaggcatttccttctgaaccaaaagcccagccataagtcagcacaagatcctgccattttttcaagagcggcggagagctgtaccaatatagcgggaattgaaagacaatccgatcgtattcctcgcacagctgctgttccttcgcaacatctatcgcttcatccgggtattccttataaagatcccgtactgtgatattgtcatgtttactcaattcctcagcccacgccttattaacaactgaggtctccatatgaggatgcactgccaaaaccaatattttcatcagaccacacctttactgttttgatgttattttatctaaaatcaggaaaagagccaaataaaaagaaagccctgctaaaaggggctttctttttttcttttattcagggcttccttcagttgtttcgatatctttcgcaaaatcagggttatccagattcgcattaaagaaatccgctgtgttcggaagtctgagattcatgttcattttttgagaaatcgtaaccgtgcaatcctcaagcacatagtcaaaaacgtgtccgcctgaattgcgtccttcgtcaatgaagtgcaggtgatagccagaaacggcgattccgtttgcataagctggtgtcaagaaacctacaatcgttcctctcacgttgtcgaagttgaaaatcggctgtgttttaaccgcttcaaccattggcacgtaaggtttttcttgaagttctactgttcttgtctgcacctttttaaacaatccgtcaatgcgaattgcataaaataagtttctgcttggcagcatgctgttgatctctttttcaaagtcttcgcgtgtcattttcgcatcaattttgtgcgtcatgtccggtgtaaagaacgtaaatgaacagaacggtgaacggtctccattttggaccggtgtcgcggttccgtctgagcgaagacggtaaaattcgccgtcaaacccaatcagctctccgtcaagcttgttaaaggttccgataccgaagtctccatatttcggaatctctgacagttcaaaatctccgtcatatactccgtctaatagagaagtcattgttgatacttgataaatctggctcacaggctgatctttttgaccacggctgagcacttgaatgttgctttctcgtttcatatttcccttcactccttttatttagtgctgttcataaaacagtgtcgtgatgcgcagagtgctagagagcttttgttttcataagttccccgaattctttcggaagcttgtcacttgctaaattaatgttatcactgtagtcaaccgggacatcgatgatgacaggaccttcagcgttcatgccttgacgcagaacatctgccagctggtctggtgattctacgcgcaagccagttgctccgaagctttccgcatatttcacgatatcgatatttccgaaatcgaccgcagatgtacggttatattttttcaattgctggaatgcaaccatgtcatatgtgctgtcgttccatacaatgtgtacaattggtgcttttagtcgaactgctgtctctaattccattgctgagaataagaaaccgccgtcaccagagacagaaaccactttttctcccggtttcaccaatgaagcgccgattgcccaaggaagcgcaacgccgagtgtttgcataccgttactgatcattaatgttaacggctcgtagctgcggaaataacgtgacatccaaatggcgtgcgaaccgatatcgcaagttactgtaacatgatcatcgactgcattacgcaactctttaacgatttcaagagggtgcgctctgtctgatttccaatctgcaggcacctgctcaccttcatgcatatattgttttaaatcagaaaggattttctgctcacgctctgcaaattctactttcacagcatcgtgttcgatatgattgatcgtggacggaatgtcaccgatcaattcaagatcaggctggtaagcatgatcaatgtcagcgataatctcgtctaaatggataattgtccggtctccattgacattccagaatttcggatcatattcaatcgggtcatagccgatcgtcagaacaacatctgcctgctctagcagtaaatcgccaggctggttgcggaacaaaccgatacggccaaaatactgatcctctaaatctctagaaagggtaccggcagcttgatatgtttcaacaaatggaagctgaacctttttcaaaagcttgcgaaccgctttaattgcttccggtcttccgcctttcatgccgaccaaaacgacaggaagttttgctgtttggatttttgctatggccgcactgattgcatcatctgctgcaggaccgagttttggcgctgcaacagcacgcacgtttttcgtatttgtgacttcattcacaacatcttgcggaaagctcacaaaagcggccccagcctgccctgctgacgctattctaaatgcatttgtaacagcttccggtatattttttacatcttgaacttctacactgtattttgtaatcggctggaatagcgccgcattatccaaagattgatgtgtccgttttaaacgatctgcacggatcacgtttccagcaagcgcaacgacagggtctccttcagtgttcgctgtcagcagacctgttgccaagttagaggcacccggtcctgatgtgactaacacgactcccggttttccagttaaacggccgactgcttgggccatgaatgctgcgttttgttcgtgccgggcaacgataatttcaggtcctttatcttgtaaagcgtcaaataccgcatcaatttttgcacctggaatgccaaatacatgtgtgacaccttgctccactaagcaatcaacaacaagctccgcccctctgtttttcacaagggatttttgttcttttgttgcttttgtcaacaccctcactccttattatgcattttaaacgtaaaattttaaatatcttgtgataagtttcactatacactctttggaaattgacctccaatatcgattcgccttatgattaatatgtaatacgaattattaacctatggaaaggaatgcatattgaatggagcttcgccatcttcaatactttatcgcagtagccgaagagcttcatttcggaaaggctgcccggcggctgaacatgacgcagcctcctctcagccagcagatcaaacagctggaggaagaagtcggagttacgcttctgaaaaggacaaaacgatttgtcgagcttaccgcagcaggagaaatctttttaaatcattgccgcatggcattgatgcaaatcggacaaggaattgaactggcacagcggacggcccgcggcgagcaaggccttctcgtaatcggttttgtcggatcagctacatatgaatttctgccgccgattgtccgggaatatcgtaaaaaattcccatctgtgaaaatagaactgcgtgaaatatcctcgtctaggcagcaggaggagctactaaagggcaacattgatattggtatacttcatcctcccttacagcatacagctttacatatcgaaaccgcccaaagcagcccttgtgttttagctttgcctaagcaacacccattgacttctaaggaatcaattacgattgaggatttaagagatgaaccaattattactgttgctaaagaagcatggcctactctatacatggattttattcagttctgtgaacaagcgggcttcagacccaacattgtccaggaagccacagaatatcaaatggtgattggtttagtcagtgccggaattggtatgacatttgttccttcctcagccaaaaaattatttaatttggatgttacttatcgaaaaatggaccaaatacagcttaatgcagaatgggttatcgcttaccgcaaagacaatcataatccgcttataaagcattttattcatatttcaaattgtcagcagacaagaactaaagagagtgatgcaggtacatgaacaatacttgcaatctcttttttcttttgggattcttatggaatttttattaatttaatataatcgcttagtacaactttatatcagtatacgtatacatacagtacaaatagttggcaaggacatcagtaagcgcaggacattagtttgattttaaaaatgaaagatagagaggtgaagtaaattattgagttcaccggcatattcacattgctcgcttttttcgtaacaatgatttttattttctggagaccaaaaggactaaatgaagctatccccgccacatttggcgctttaatggttttattgtgcggaagtgtgtcattggcagacttaggggaaatcggaacaaaagtcacgggtgcatcggttacaatccttgccactatgattatggccattgcactagaaagctttggtttcttttattgggtggctgcaaaactgctccaacaatccaagggttcaggcatcaagcttttttggctaaccaatttgctctgctttctcatgaccattttcctgaataatgatgggagcattttgatcacaactccaatccttttgcttgtactaaaatatttaggtttaaaaaaacatcaaaaagccccatatttattaagcggtgttttaatagccacagcctctagcgcaccgattggcgtaagtaatattgttaatttaatttctctcaaaatcattggaatggatctatatcttcacaccgccatgatgtttgtccctagtatgatgggactcatttttatgacttgtctactgtttatgttcttttataaacgtcttcccaagaacctgccagatataccgggccattttcagtctctgcggcatagaaggtaccatcctcttcattcgccatcagctcctttaccagaacgaaatcaaacaaaaatcatgttgtttgtgcttgcatttgtttttctcgtcagaatgagtctatttgcagcatcatataccggtatttctgttcctctagtcgctgtcatcggatcttttatcctgttgagctggagatggatttatttcaaaacctccccaagagacttgttatataaatcgccttggcacatttttatattcgcttttactatgtatgtcttaatttatggtctgcataatattggattcacagagttacttgtgaattattttgaacctgtggtttctggaagcctcgcccatgcaactttcgcatcaggtatctctacttcagttttttctaatctctttaacaaccatccagcgttaatgatcagtacttttaccttaactgaaatgaccctgaatccttcaacaacaaaaatcatctacttggccaatattatcggcagtgatatcggttcattattattacctatgggaaccttagcaacgcttatttggatgcatatattaaaacagtatgatgaaagtatttcatggggcgaatatataaaaacgaccattatcatcattccgctgactgttctttttacgttaacatgtttatatttttggatcagttggttatttctttagcacagtatgaaacgaaaaactgccttctgctattcaagagggcagttttgcatacactagggaagatgcattgtctttagatgatttaacttccaaatgattggctctccatttgcgttaataagctcaatgatattattagagacatcctttaatagaccaactttttctggcacctctcccatatcaaatatgaccaattcaccaatattttttttgatctgctcctcaaaattacgcacaagaggaactttggaaggcatgacaggcaattgtgagttgtcaagagtgtacggtgtttgttcagttgaataaggggtaaaccattttaaatgatgcatagatataaaaagtattttaaatacaggtgagaaaaatacaatataatcgtttaaaacatttgtaacatacccatggatcgatcgacccccagttacataaacttcaataaactggcctttgaccttgtttaatgtatttctatatgaaaaagcttgagtttctgcctctatggatggatcttccggattgatcaaaaatggcttctcagtactggtcattattttcgccttgtttatttgatgaagatgcaacaagggaatataaagataattgcagccatcaaaaataacaaaaatatcctgtccgatatctatgagggtgccgacaaaccttgtatctcctgaaatgacaacctcaacatctgtgttaaggaattgattcaaacctttcacgattctcctcctttaactgaaaaagggcatcacttaatctgatgctcctccattatctattaaaatttacgtttccagtgatagtctatcgttctgacaatcgtttcatagctataatcatccttttgtttttctgaacttttgaaggaacttgaataacctggtgatcttgatgattgataatctgatgatcttggtgatcgtttagatgattttgatgattgataatctgaagattttaatgatcgtttagatgattttgaagaactttttgaacgtgacgaacggccagatttggatgattgataatccgaagattttagtgatcgtttagatgattttgaagaactttttgaacgtgacgaacgaccagatttggatgattgataatctgaagattttagtgatcgtttagatgattttgatgagctatatgattttgaagaaatgaacgaattgctgtccttatcattattgtcttcctggctttgttcatttttttgatcctcttttttgtacgacccttttggtcctaagctgatgctttttatgtgaaaaggatagatgcgaagcacctcttgatttttcactatagtataatggccgtcggcattatctacaaggataccctcaatggcttccggacctccacgattaattgaaacccatttatgagtcagactcttaaaaacctcgcttaaatcatcagcttccaaaactccaactggcgtctgctcttctattttcaaatcaggctcgtgtttacttatacttttgatgtgatggatattaaaatacactaccccatcctcatttgtgtttaacgcagcgtaatcatctcccagccagaccaatcttccttttttagattccggacccccttggttaaattgaactgattggtttattaaatgtccgattaagctatgaaaatcatcagcatcgagcatttcctcagtctcaattgtcgtggtgctattattggtatcctcagtaatacttttcacatgctccaactgataataaattatttttttttcagcttgtaaagctatataatctgattttacagctgttaattttccttttttagattccggacctccacgatatacagtaacaattttatctttcattgagtgcaaaaagttataatacgatatttcattatttgaatgatatttcattctcctcttgctcattcaaattcctcctagtcacttatacatagatgataaacatactgcatatatacgtgtcacatttatttgttgaactaattcaatagcctaattgtcgctttttccgcgaatacccattttcacgcattcataaaatacttaaatgatctttgaggtattgtgaacggtttttaatatactcgcagatcacatccggctcacggtcaaaacgctcaacatcattctttttatatgggtccatcaagataaaaggcctaatccgttcatacatcgccatgattttcggttccatatattctattgtaaaaagagattggagcgttttttctaacaggcgcttgtaggacttgcgaaactcggattcatccaatatccgggcggttagtgtattaaatccttgaattcttacataatcggcagccatccgctctccatggatatccctgccccaagtcgcatcataatcccaaggaatcacctcaaataatccggtttccccgcttctgtataatgcgtagttgtggacaaacccgtcatagtttgaggtgaatacaataccggcaagccagcgcaaatacttgtcgacatccacgtgttttgtcacttctgacttaaactgagctttagggaccgtattaattttaaaaatcatatcctgtaaataaaaatcatcctcctcagtccctgttttcttttcatatccaagctccagcgatgttttcgtttccctttctaaatcgctcatcagagaaaagttggcatcatcatccaccgcataaaaaatcgcgccatcagccagcttccttttcgccaaataatattcatctacggattcaagttcaagataaaccccttcattcttcccattcatctttacaaacacaaactctgcctttggagacagtgtccctagctccgagaaaaaatccagagacaatttgtttctcatcaaggaaggatctttatactccgcatttaagtgaatctctcgcgcgccgcggaatgttttcggctgataaaaggaaatatggtatgacttctttttgaagtctctgatatgtgatccccgataagcaatatcaatatccagccttttttgatttaccttcatcacagctggcaccggatcatcgtcccatatatccttttttaattcacgcaagtcttttggatgaacaaacagctgataaagcggtaaattggattgattcttcatccataatcctccttacaaattttaggcttttatttttataagatctcagcggaacacttatacactttttaaaaccgcgcgtactatgagggtagtaaggatcttcatccttaacatatttttaaaaggaggatttcaaattgggccactattcccattctgacatcgaagaagcggtgaaatccgcaaaaaaagaaggtttaaaggattatttataccaagagcctcatggaaaaaaacgcagtcataaaaagtcgcaccgcactcacaaaaaatctcgcagccataaaaaatcatactgctctcacaaaaaatctcgcagtcacaaaaaatcattctgttctcacaaaaaatctcgcagccacaaaaaatcatactgctctcacaagaaatcacgcagccacaaaaaatcgtaccgttctcacaaaaaatctcgcagctataaaaaatcttaccgttcttacaaaaaatctcgcagctataaaaaatcttgccgttcttacaaaaaatcgcgcagctacaaaaagtcatactgttctcacaagaaaaaatctcgcagctataaaaagtcatgccgcacacacaaaaaatcttatcgttcccataagaaatactacaaaaaaccgtaccaccactgcgacgactacaaaagacacgatgattatgacagcaaaaaagaatactggaaagacggcaattgctgggtagtcaaaaagaaatacaaataatctaagttttcattgtttcaataggctgccggcggaggtacggaagcctatttttttatttgccctgtattagatatatgtcatgacataacatatgcaacccgcatcatttggtttcctttaaaccatttcgttataatcaaggtatcctaacgataaaggcggttgttgctatgtacatatttcaagctgatcagcttagtgccaaagacacatacaagctattgtcaggtaccgttattccccgccccattgcatttgtgacaacactttcttcaggaggagcggtcaatgccgcgcctttcagtttttataacgtcgtcagctcagatcctccgcttctcagtatttctgttaacaggacggaaggacgccaaaaagatacagcgcgaaacgcagtggagaacggagaatttgtcgttcatgtcagtgatgaagccatcattgaagatatcaatgaaacagctgcaagcttaaggccggatgaaagcgagcttacacgcacctcgcttcatcctgttgaaagcaaagctgtttcagttcccggcattaaggaagcccgcgttcgctttgagtgcaaattagagcggcatattacctttgacaatgatcaaggcatcactacagcagatctgctcatcggaagagttgtctgcttccacctagatgaaaaggtgtatgatgcagaaaagggatatattttaacggatgaattaaagcctgcctcacgattggcgggaaatcactatgccaagctgggggaagaattcacactgattcgtcccagctgaagagaaggactatttaaatagaagaaactagtcaaaaagaccttatgattacaaaatatcgcctgtaaataactgaaaaaatatcaaaaaaaagaacacccagagcaagctcggggtgttcttttatgaaacgtttttcctttttcttcgtataaaggtagattaggaggaattggaatgacaaacttttggattttaatgctgatcgctattaccatcagtctcgcctctcaattttttataaagaaaaaatacggtattgataaatccggctggcgatataagcatgtcagcaatacacacaaatggatcgaaatcactttacttattttgtttgtgttttcactctccttttttccagttgaatatttgcttcttttattttttattgtgattgactcaatacgaatttttatggagtggcattatagacctgaagataaacagtatatgtaccacattgtagaggtctcacttatgtttatgcttttgatttatatttgtaccctatagttatttaaatccccacagccgctccgtctccccgaggatcggctccgccttggagaaagccttcttcatcaactttgattgcagccgcttgtcccatcagcggatcatagtcaccgacaacctccacgagatgcccgctgtctttcagtttttggattgttttgtctgtgaatctgccctcgactctgagaccttcgtattcctctccccacgttctgccccatacccagcgcggttcgctgattgcttgctgtggatgcattccgtagtccagcattcgggtaatgatggccgtctgagtctgcggctggccttcgccgccttgtgtgccgtacagaatttttggctttccgcttttacagaccatagccggcatcaacgtatggaaggtgcgctttctcggttcaagcgtgttgacatgattttcatccagtgagaaaaatgatccgcggttttgcagtaatatgcctgtatcaccggctgtgactgccgagccaaattcaaagtacaggctttgaatgaatgacactgcgttgccatccgcatcaattacggccgcatatgccgtatcacttcccaccggcctgctttctgccggttctgccagaatgccgatttctcccgccaatcgtttcgcataatttttatccaaaagcctttcaagcggaatgtcagcaaacgcagggtcagtcaaaaaggcattccgatctacaaaactctttttcagcgcctccacaagcacatgataatactcaaatgaaccgtgctcgatttgggtgaaatcatagttttccaaaatgttcagtgttaataaaccggtaaatccctgagaattcggcggcgcctgatacacactgtatcctcgataatcacttgatacaggctctgcccactcaccccgatgcgctttaaaatcatcgattgtcatgtaactgccgttattctgtaaatgtgagacaattcgctgagcgagatctccttcataaaatgcgcttcttcctttttcagtaatcaagttcagactgtctgcaagctctttttgcacaaaccgctctcccgggacaggcgctttgccccttctcgtgaagatgtcagccgtgtaaggcgtggaagccagcagttcaatattcttttctgtgtgacgacactgatcagctgatacaggaaacccattttgggcataatcgcgtgcgggctccaatacatctgcaagagacagacgcccgtactccttcaggaccgcatcccagctatcaaccattcccggcacggtaatggcactgtcaattccccgcagcggaatcgcgctttttcccttatatacatctctcgttacgttttttcctgaacggccgctgccattgtagacttttactgcctttgtttcctggtgaaaggtcagccaaaaggaatccccgccaagtccggtcatatgcgggtacacaaccgcaagacaagcactcaccgcaacagcggcgtcaaacgcgttgccttccttatccagtatgcggtttccggcttgagaagcgaggtaatgcggactgacgaccatttgctttgtaccgatgacagatctgttcatcacaagtccccttttttaagaaattttcttcagtatagggagcctgatttttcacatctactgatccggcagaaaaactgacgaactttcttcttttcgcaaataacaagatattttcgcattcatttcgaaaacaaatgaaaaattattatttcgatacgtaacttttatgataaaatgattgctaaaaggctacgaaagcaggtggagcaattgagtcatgaatatcaaatccccaaccttgtacttgatgagactgataaacaaattctcacgattttgcatgaagaaggcagaatttcttatacggatcttggcaaaagagtcgatttgtcacgggtcgccgtccaggcccgtatcaaccaattaattgaagccggtgttattgaaaaattcaccgctgtcatcaatcccgctaaaatcggcattcatgtttccgtgtttttcaatgtcgaggtagaaccgcaatttttagaagaggtcgctcttaagcttgaggaagagcctgcggtcaccagcctttatcacatgacaggcccgagcaagctgcatatgcatgggatctttgccaacgatcaagaaatggaagaattcttaacaaaacggctgtatccattgcgaggcgtcgtcagtgttgattgccagatgctgatcaaacgatacaaaagccgtatgggaatgaagctgtaaaggagagaaacgaatgaaaaaccatccttatcgggatatgacggccgcaatggttcgcaccggcatattagggttcggcggcggaccttccgtgattccgctgatccgccatgaagcggtcaataaatataaatggattgacgatgatgaattcggagaaatattagcaatcgctaatgcgcttcccggaccgattgccaccaaaatggctgcttatctgggctttaagctaaaaggcacattaggtgcagttgtggcgaccctcgcccacattctgcctacatgtcttgcgatggtgggcttgtttgcggctgtaaatgtgttaagccattcagcaattgttgcaggtatgatcggtgccgtcacgccggtaattgcggtaatgctcggaatcatggcgtacgagtttggccaaaaagcgcttaaaggtttcggctgggttaccggcatcctgttttttatcatcgcttttatcggcctgcaaactttacagattaatcccggcctggtcattatcattttcttagcgtacggggcgtttcattttaaactgaaagacaaaatcacaaataaacattcaaaagataaaggaatgtcagcctcatgatatcgatctatttatttatggcgttttttatcgcaaacctactgggatatggcggcggacctgcgtctatcccgctaatgtttgaagaagttgtaaacagatacagctggctctcaaacgatcaattctcaaacatgctcgcacttgcgaacgctttgccgggcccgatcgccacgaaaatcgctgcgtatgtcggctacagcgcaggcgggtggcccggcttcctaattgccctgatcgcaaccgtcgtaccgtcggcgctcgcattgatcgtcctgctgcgcatcatccagcgcttccgccaatcacctgtcatcaaaggcatgacgctgtccgtccagcctgtcatcgcggtcatgatgctcattcttacctggcaaatcggcgcagacggcatcaaagcgatcggctggatccaatcgatcgtgattgcgggaatttcgctccttgccatgacaaaattcaaaatgcatccggcatttttgattatcgcggcgtttttatatgggggccttgtgatccctcatttatagaaaaaagcacctggacaggtgcttttttattttggcccagaaatgccgtttgatatgacagctgtttcttctcctgcgtcactcttgatgatgtgcttgacttgcagcgtggttcctgccattctcacagattgcttcaactcggacgaattggtttcaacttgtatccaaacaggaggctggaccttccaaaataaatagagtgcaagaatcagcaagccagcaatgaccgacagcaaaaacttcatatcgcatcgcttcttttcagtaagcggcccgcagcggacagcgcctgatgatcacgaagaatatcgcctggacgattgccttctcccagcacatagcctttaaaggacattcccataaaatgaaaaatatgttcgaattgctgaatcagcggcagcccttttatttttggattgtctccgcccactgctattacatatgcctgtttcactgacatttgctgtttaaaatcaggaaatctcggatctctcaacgtctgtgaccagcgatcaataaacagctttaatgtccctgacatgccaaaccaataaattggggtggcgaatacaagaatatggcactgcaatatccgttcaatgatagaatcgtagtcatcttgaacaggacgaaagccgccttgggcgtgacgcagatcttcaattggctgaattcgatatttctgcaaataaatgtgctccgcatcgaatccttgaacagccttctccgcaagaacatccgtatttccgccagaccgagttccgccgttaataaccgcaattttcatgatgcatctgctcctttgtttacgaatgattttcttcatcttataatggattcatctatcaatacagatgattatttcgattaatccaatcgctaaaaccgatttagaaaggaagagaacaagtggaattgaagcagctgatcacctttattacggcggcagaacatgtaaacttcaccctaaccgccaaaatgcttaattatgcacaatcaagcgttacctctcagatcaaatcacttgaagaagaaattgggacgcctttatttgaacggctcggcaagcggcttatcttgacagaagcaggaaaaacgttcaaatcttatgcacagaagatcattgcgttaacagaagaagcgaaaatggccgcaaatcaagtaagagaaacaaccggaaccttaaaaatcggggcgacagaaagccagtgcacataccgcctgccccctatcataaaagaatttaaacaggcttttccccaagtaaagctcatattcaaaccatatatctccaatgaacaagcgaaagaacagctcttacagggccagcttgatatcaccttcatcttggatgtaaaccggatggaagacgcactgcacgttgaatctttgattcaggatgagatcaaaatggtggctgctaatgaccatccttttcctgcggatttaccagtaacattgaaggatcttcaaaacgaaactcttctgctgacagaggacggctgctcgtaccgcacgctctttgagaacaatttgcatgactccggtgtctatcctaacaaattggaattcgtcagcatagaagccatcaaacaatgcgtgatggccggacttgggattggaatcttgcctgaaatgacagtaaaagatgatattgcagcaggccggatgaaagaactcaattggcagagcgattgccccgttttcactcaattagcatggcataaggacaaatggatgtctgcgccattaaaggcttttatcgatttgacacggaaaacattcaaataaaacctctccacaaggacgacaaggtttttgagaccaggaaagcacacacatacaaaaaaacacttgatgacttagagccccaagtgttacatgtgatttttctgataaaacgttcgcaaaacatgcgtttcaaggtcagccaggcggacagggattggcaatctgctttcttgattgatcaagctcatcgtgatctgatagctgctgtctaaatcaatataattaccgcaagacaagaaaataggcttcacgtccccccgcgttcgcagcgcccggccatatacctcgccgtcaatgagaatatcggtgtatgcaccgacttcattttcaggcatcacgaaatcatagcctttgattttgagataggttttcgcaatcccaatcgtcggcttgcccagaaaaaaagccgcatgggtggcaacgcccatatgattgtaatgcagatatccgttgccatcaaacaagaagacatccggctccgtctccagctttttcgccgcctcgatgatcaaaggcagctcgcgaaacgcaagaaaaccggaaacatacggcacgctgattctccccatgctgtgcactttttcaatgacttcttttgtatcagcgtcaatcacgataatactgcacactccgtatggttctccgttctgctcccaataggcgagatcgacgcctgcgcaggtgttgatggagttgggatggatcgtgtgggataggttgatacgatttctaagggattgttgtgtttgaacaaaatccgattcatcttttagatgaaaatcgtgtatttgatgtatttccattttacttgtttccctctcttcgcgctcaattgtcctgcatgtcgattctagcaatgacaccaaattatatcattgaaaaaagcagatagtataatctgcttttttattactattcatttttcatttctttcataaaaatataatccaattgtttaattaattctttaagttcagtacacataatatcctctaaaggattttcccaatcttcgttttttatcagttcaatcccatagcttccggctggatcaccttctgggtaccaccctacgtcaagcagcaaattttttgtcttatgagaaatctgcaggagatcttgattaaagtcaaataaccaagcatcgtcatttgcctctagcgtcttaggatcagtatcctttaatgtaatataatcaacagtccaaccagccggtatctttagccttaaaaaattgggaatctgttggcttagtggctgtaaaccctctaaaaccccgcttcccacactccagatttgatattctaactcttctaataattgttctatctcattaaaagactcatcttcataaatcttatctgtttttaagccagctactttgatatggtattgattattttcataacttaccttaataaaggccttacgtttttcattttgtagtattagtaattcacatttttcttgcattcttttttctgaacataaattgttcagtactacagaccagccattacagatttttaatggctgcagttgagaaatatggtctctttccatcccgcttctccttgcactccatattgttatactatctataaaaaagcatgccgatgacaacacggcatgtttttaactatagcaattctaatacatcagagtaaacaaggcatctcctaatgttaatctcctgttgaaaggctgtatatgcggcaattcactccactcatacacagtatcgtagtaatcatacaaataactgagttcaataaaccctttctcttgcattattttattaatatagttcgttccctgaatgaattctaaagattcagcggtgcctacaatatcataaacgccatcgattaaatcgtgtcttagggaataactataatctaatacataaacaggaaccaatttagatactttcatattgatttgctgttctaaatgaaaaccattttccccagaaagatcttgcaaatggatatcaatttctcctgaaggattgtttaaatctctaacttcaatttttttcaaaccttttatttgattaaattcatcaggtacttttattttctctgcgcatttgttcttgtaccattcgcctaattccctattcacaaatagacgataaagcaactcaccaatttcaggatattcattaataaacctgattccatgttccataaatagtaaccattccatcctttaatcaagaaaatctaaacttcattccaccaagtagttgttacttgttttaaatgatattcaatatataaaatcacttttttatagtcatctgatgaaaattctttaataggatcttcccaatcattatctttgactagtaaaaccagataattaccttcaggagaaatgtcaggaacccagcctaaatcaagcgttattgaggattgttcatgataaagctgcaacaaactgtctgtgaacaaaaaccaggaatcatcattcggttctaatgttcttggatctatttcaacaaaatgattataatttactttccaaccttgtgttattcttaagggatgtatattagcttttggaacatctaatttaacatgttttctcatttatataacctctttagagagccgttattcttaaagtctgtttttagataacttgtcaaccaactatttgagtgggagacctgaaaggtgaaaatgtagattatgaataatatttacttagctgtacgaacttcattttacaaggctgccccttgcatctatattcatcttactaattatcttatagatcagtttcaatgcaaaaattttaagtttaaaaaacctcgagaggcaagcgccaatcgagggaaggttagtttttttctacttacttgttaaaggattaaaactgatattcttccagaaaaacgttatgagaacattagctgcatctcatattatctttcctctctgcacaagtgattatattcaccaaatttagggaaatcatcccagttgctcttaaggttgtcgctagtctcacgctcttcgaccgaaccggtcttgaaatctgtcttctccattgctatatgaccatcttcgcgaaagcctaaaatcaaactgctaacttcattatcagttgcatcatcatattcccaatacattgctgttcttaagaagattttaccatcacttataacttcaaaatcataattcagatacttacgagtcaagtcatcataaaaacccactgaaacccatttatttgttacatttacaacatatttaggtttttcgccttcggttaataccgcagtatatggttcatgtttttggtgatgtaagtatgcggtacaatcatcaagaatattccaaggctgtttttttatgtccgaccattcatcacaataataaactttcatagtcaattatacaccttcccatttatatccctaataataatcctattttttgttgcttcatcaagaattttttgtggaatagctttattttgaacaggtacttctaatatcaattcacctttcagtcatccgcctttaagagcttttggattaaaaggaccatttgatattttagaccctgaagaatattttttagtaatctcgttcaagtaactcagtgctgtcttttcttgaacgtcactaagttgagtatacttcctggaaactatctccttatttggagaatatgaatcaactacgtactttttgccgcctgcttcttttgcttctagctctacttcattataagggtaacgggggcgattttccttattgaaattatttcctgcttcccaccgttctttaagccaagacggtaatggattcttattagatgacttccccgtacccttaatacctttaccactactaaccatcttcacaatcccaagatccttaacagccgtcttttccacatcgacacgtactgtcgggattccgaatgtaaagccatccggagttacagggcgttctgcgtacacgtggacgtttgttgggactttgaattgttttactttctctagtgttttgtttgctttttggacttttgaatgggttgcaagcgggatgcctttatcaatatgtttcgccagtgcaccggctccaaccaaactcagcacagcttccagcgccccctgcttccgcttctcctcagacactttgtttccaaacatatcccgtcccgtgacggcttctgagaatccgtttgacgcaacaaggccgtatgcacccatttctgtcattttgagaatgtctaaggatttgcctgttttgtaggcgtctaaagcgtgttcagccgcgatagcagcttttccggttttgtagatggcttttccgcctttgaaggcgcggcctgcccagccgacgactggtataaatcccacggctgccatggtgccgactgtgacgcgttcaaagcctatacttatttacgctatataaaacagtggacaacaaactaataaaaaaaccttgaaaggcttcagtgccaatcaaggtagaaaatcaaaccaactcgaagcgtttatttgtttttaataatgccttaagattttttaacaatactattaattccttcaaatataatatctctcataacttcattattactgttataatttctttcatttcttattttattaaaaacctgctttataaccccatcaatcattattgttaatccttctatatcttcttcactaccctcctttttaaaactttcatttattattaccaagctatcatcttttgacattttattttctcctttactctctttctttctcattaaaaactttgtctatataatttacttcatcaaaaatccagtatctatcctcttcaggaatataactagtaaagtcttcccgaacccctgtccaattattaggaacataattttcaaaaggtaataactcaggatacagcgaaagaagcattttttgattaaagtctatatataatgatggccttaattctagaatagtactttcataatcctgatgttcaactaacttctttaattctgaagacgggataatatagtcagtatattcttttaaataaagacgataattatcttcatttacaactgaaatgttatttcttagagaaagagcaaagtccatatcaaaactaaacccgtttttttcataggcttctttatatttcatgatatctagtatccaaacatctctttctgttagataccatgagaattgagaagaagtctttaccccgactattatattttgggcatactccggttttaataacaacgaaaacaccactttctcattctatttttttggctgaatgcccatattcctctaaccactctatccatggttccgccggaagttcataactaactcccggtgtcgtaggatcaacaagctttggagcagttctcccctggttacgagggtttttagtatatccatactgatcaattactgtctccttgattaaatcatcaatctctttaggtaccttaaattctacaatttctccgcctggtcttgctacatctcgataatatttagcgtgttctaaattgtaagcacttatgtttaaatcagcatttttaataggaatagcaatgcttccatcactatttactttaattctatactgacttgttttatttcccgctcctcctccttgaactctgtaataacttactgattgttcgacaggatcgacagattttttacttgattgtaacttatcattatttactttcttcgtatataattgtttcttctctggctttaagtcaaatgtatggccagtcgaagtaacaatctgttctttatttatatgaccactttgcttaattttagaaaaagaataactcttatcaagatttcttcccatcgatagcgtattgtcaaccgacttcgccaatgcaccagcaccaaccaaactcaatgccgcttccagcgcacccgttttccgcttctcttcagacactttgtttccaaacatatcccgtcccgtgacggcttctgagaatccgtttgacgcaacaaggccgtatgcgcccatttctgtcattttgagaatgtctaaggatttgcctgttttgtaggcatctaaagcgtgttcagccgcgatagcagcttttccggttttgtagatggcttttccgcctttgaaggcgcggcctgcccagccgacgactggtataaatccggctgcggccatagctcctgctgtcacacgttctgcggtggagagtttttctccggtaaccggatcaacgccttcagttgctcttttataatcataatagccagtgacttctccagtaaagttgcaaactccatcccatgttttttcgtaccatggtttgtttgcttcttcctcggctttttcctggagacgtcttgcttctgcttgctgggcttttgcatcaatataggttgttccttgattttctacttcaatgacgcttttgtagacttcattgctgtggaaggcttttttgtcatagtacataggggatgcgctcttcccattgctggtggcctgcatgagaacagaatatttggtgagcactgcgttgtccagagattctaaattttgatattcagtggtcagggattcatcaagcttatcgacagctgtgatcgtgtcacgtctgactttttgggcatcgcccatcttatctgcatactcgtcaagcgtgtacatgtcgaggtcaataatatcgctgatgcctgacaaaatagaatcgatttcttctttatgagcggagactatctctgaggctttcaggtctccattgggcagctcatgatccaaaaatgaagtttccacatatgaatcattcagttcttgatctttaatatcgcctgaaatgccgtttaaaaatgcaatttgagcagagacaagcgtcagccagctgtcgacgatttccgcctgtccctgaaagaaatctttaatattgtccgcgccttttcctttaaaattatcgcctaaatctgcaactccctgaaacgcttttttcagcgtattcagctgctcttcaagcgtctcatattgcttttttctgctcttcgcttcttcgattaaagattttgattcaaatactttactcatcgcactgccctttctgttctattttaccgctatcgcctcgtcctgctctttaagtgaatctacgttatcctttgtatcctcgatatttttctgtaccgcttttttgtaatctccgagcatggttttgatgttctcctcacgctcatgatattttttcgtataatcgagtttattttttccattggaccccgcggcgccgattgatacgtcagcaagcgcatctttgacagactctaatgttttgattacagcatcgtatttcaatttaatttctgacataaaaaagatcaccacaatttaatagatttaatttgattaacagcatcctccaagaattcttcacccttagcaagagtatgaccagcaaaattcgctagctttaattctttgtcatagagaaatttcatagattccaactgaataatctccatctgaatcgaagccatatactcgttatatttatcattcacaatcttagatgcttccgatttcgcctcttctcttcccttgtcgaaatcatcggcttttgttcccgtccaatgcttgcccaattctggttttacaatttctttgatttcagtgattgcctcttcttgcagtgtgtctatgtccttttttgcttttttcagcttttcgatcttgtcttccacgtcggaaatttttccgttgagcgaacttttgatatccgccagcatactttcataacccatctgaatcacctcttaatactcaaaaagtcgtatggaggggctgatgaagatagacttttccatactttatttccatatattatattttaaaatagccagaaggcggcttaaatagggtaaatggcttaatttaggcatataacgctcttgaaatgtaggtatttgatcttgtttttgttcgttatacagctaatgaaaacgttttttaaaatgaaatcacctaaagtcatagttataaaggcacttgaaagaggcagatgttgttgatctgcctcttacggcgctgagcttattgttcatgtttatgttcttcatcaggtcggccacgtctgattttgtctttggcttctattattccccgcttctgaccctttggatcaaaagcttgtattagctgcagtcccagttgtacagaacgtttgaaaagtcttttttccttagatcgtcaggtgtgatgaaaaaattggcgatgccgacgtctccccacattgaatcgatatcatcgtctgaatcaatttgtaaaagcatgatggtgtgttctttatatgcgtattcccgtggatcatgctgggtaaaagaagcgtatccgccgattttatggccaaatccgttttcagccagttcattataaatgtcttcttcatcctcgccgaactgaccaaagaactccattgtttccatgcccgtatactgctcaaattgaaaatctgtaggcagcacccattccgaagatttcacaggctcgactgccgcttctgataaaatcggaaaatcacattcgcctgtgccaataaatgaaaaatcagaaacaaggtcgtcttcgttttctatgatattttcaaaatagatcactctgaaattcttttgttcacatcgatcgtcaaaattcaatccatagacgtcatcatgaagagaaatgtagaactgcaggatacctgaagaaggatagccgtcaagctggggaatgtgcgagaaattaatctgcgccagaagcttcatcggctgtccatattcgtcagtcggatatgtttcatgcttggggaaatagggatcaccggcaattttgctgtcatatcgtcctgttttcccttttctcacattcagtttcacgtattctttcgctgatttctccagcaagtcgcggtacggtctcattttttcgggtagatgattcatcagattctctccttttccggcatctccaaggttttattttctggttttcttcgtttcttctaatgtttttcaaacgattgtttaaagaagccctacttctgtataattttccaaacaatagttaaatagtagcaaatgtattcagcaccccgcaatagatgaaaaaaagactggtgcgcaaccagcctttctttttcaactattgaattgcacctgacggaacaaccgccttccgtccgacagaataatactccactcctgcagccaaagcctcatccaatgtgtagcagtttctgccgtcaaatatgagcggcgtttccatcaaatcctgataagccgctaacgggaattgtttaatgtcagcccagtcggttaaaatcatgacggcgtcagaccctttgacagcttcctcgatcgtctctttatattcaacagcttgcgggagaacatgctttgcatggctaactgcaatgggatcgtaggctctgatacgggcgtcgagcgcagcgagacggtctgcaataacaattgacggcgcttctctcatatcgtcggtattcggtttaaatgacaggcctaaaagggcaatcgtttttcccgtcaccccgccgagcctgttcagcgctttatcaaccagcatcgcctgctgattgttgttgactttgataaccgatttcagcagttcaaaatcatgctcgacattgccggcaatttgcacgagggcgtttgtgtcctttggaaaacaagagccgccgtagcctatgcccgcttttaaaaactggctcccgatccgcttatcctgtcccatcccgtatgcgactgcttcaatatcggcgccgaccttttcacatatattcgaaatttcgtttataaaactgatcttagtggccagaaaagcatttgaggcatatttgatcatctcggcgcttctgatatccgtttggtatatcgggatttgaaacggacggaagagctcctccagcgtatttgctgttttctcatcggccgtcccgatcacgatcctgtcaccatgaaaggtatcatagatcgccgacccctcacgcaaaaattccggattggatgcaaccgaaatactgacaggctccgctagatgttcagtgatcagtccattaatcaaatcgtttgtcccaacgggcactgtgcttttcgttaccacgactgtatctcgtttgacatgctttgcgatgcgtttggccgcatctgtaatttgctccagattggcgtgcccgtcgcttttctgcggtgtgccgaccgctataaaaatgatgtctgcctgtgccaagcctttctcatagctcgtttcaaagttcagccgtccatcagctgtattttttctcatcagctcttcaagacctggttcaaatatgggggaaatgccctttctcatttcatcaatcttgtgagcgtcaatatcaatgcaggttacatgatgtccaatctcagaaagagaaacacctgtcacaagaccgacatagcctgttccgatgactgttatattcattgtttccctccaacagttaaattgctgctttgcagcttccgtaatatcgtatgagaacatcctatcatgaatgcgaatgatctcccgcatagcctgtcgggtacagcctgtacagatttctgaaatgtgattcaatcatacaatacactattatatcgctctcaaaaagaaagtggtgaaatgagaatcggctgttaaaaaagaccaaacaattttcttcttttgaccggttgcggaggctgtctgaagatggtctgattccgcaggagaagctctgcattttccgtcagcatataaggaagttccgagccgaattctttctctagaacataaagggcctcttgagtgtgaaaatttctcgttttcacattatgggcatctgaggctacgaaatggatcaaattggcttcaaccagccggagagaaaatgctttcagctgcttgccgaaggtccccgcaagacttcctgaagtaatctgagatgctgctcctttttccacaagatgatacagcaaggacgggttttcgcgaatttccctgttgcgttcaggatgggcgataaccggaatatatcctttcagctgcaaatcataaaaaagctgctccgcatatcggggaacgtgatcaaacggaaactcaatcaagatgtgttttgtatcattcagcgaaagcagctgctgtttggcaaggtcttgttccacctcgccgtagattctgatttcctgtcccggaagcacatgtaaaggaatgtcttctttgattaaacgtttgtttaactgatctgctgcttctctgactgcagctggctcgtttttatacacaccgttgttatgatgaggtgtcgcaatgatcgtccggattccctgacgaacagcggctcttgccatttctatgctgtcggccgaatcacctgccccgtcatccattgcgggaagaatgtgacagtgaatatcgatcatgtcctagcccccttttttcgcaaaaataaataacgggcacgatgcacgttatttattttgcatgaaattgtccttgtttccgtaatatccgtattcagagtgcttcgaaagctttttgccgttcataatcgccccaagaagcttgcttttgcacgtttcaagcgcctctttcgcttttgcggcttgttctttttctgttttcccgcttgaaataaccagaacagaaccgtctgccacgttgcctaaaatctgtgcatctgctacggcaagaataggcggcgtatcaaaaatgaccatatcatatgccgcacacgcttcgtatgcaagctccttcatccacttcgaggagagaagctcggccgggtttggcgggatcgggccgctcgtcagcacgtcaagatgtttttcattcgatgcctgtacagcctgctccatagagcttttctttaataaaacagatgttaagccaaccgtattttcaagaaaaaaggccgtatgtactgttggttttcgcaaatcagcatcaatcaggagcactttttttccctgctgggcgaatacgacagccaggttggcggccgttgttgattttccttctccgggacaagccgatgtgatcatcactgatttcatctggcggtccactgaagcaaattctatattcgtgcgaatcgtccgatattgttcagagttcaaggatttcggctctgtcattgcaatgacatttctccgcatccgcgagtctctgctttttctaagcgccaaaatgtccactccccgttttttcagattggaaaccctgtaaggtctttgctgttttctgctcattcgcaatggtggaaactgtccctaaaacaggtatgtccagcaaggattcgagctgctcttccgatttgatcgtattatccaaatgctcgagcaggaaggccagtccgatgcttcccgccaatccggctgcaaacgcgatggcaatgtttagtagcggctttggcgatacaggggacggatgttctgaaacctcggcttttgacagaatgctgacattgtcaacattcataatggatgtgattttgtcttgaaaaacagatgctatagtattggcaatatgagccgctgtttccgcgttttcatccctgactgatatgttgaccacttgggagtcctgttcgctggatacggtaattttgtcattcagttcttgggatgtcatcgacaggcccatttctttaatgacttcatctaagatggcaggacttttaatgatgacattgtacgtattgattaactgaagattggtttggacatcgttaaattgaacttcttttcgttcatttttcgattggttgaccagaatctgagttgaattttcatagatgggtgtaagtgcgaagaaactaatgagtccgccggcagcagtggcagctgcggttacaatcataatcaaaagtatgcgttttgttaacgttgataatatctcttttaagcttgtagattctcccatgatacctccaaatctcttataacatccttttccatctacgattatacaacgttgaaaccgcatttctccagcttttcacgtgacataattcgacatttttttacaaaacgaaatgttactcttttttatgtaagcgctatatttactgtgttgacagcgctgtctcattttctcttattcgtgcagtcacgtaacctcgcataaaaaaatcccgcaaaaggcgtgcgggatttttatgttgcatatccatttttaatatgagaaatcaaattttcaagcatttccttcgtcgtcatctcagatgactgctcaccaatttcatgtgcatgcatcaaaattttcagaaattcttcttgattcaatttcttttcactcatcttttttttcctttcagcttccattaagttgaaaacacgattattatatgatgctggttatcaatttgcaatctctaatacatcattcgacacatcccattttttatgtccttttttaggaaaaactttttaaggccgatgtgttgcgatataatagagaaattggatctttttattacgtgactcggttaggagcgataatcatgcttcagaatatgatttccaaagacgatgtgctggcatctgctgaacagttaaaagaacttcttccttacaatgaggaaaatgttcagctgatcaaaaaagcccttattttatatcggcaggattcagtctatcgtttacaagcagtgagtccgacggaagttacggcttacgtgcaggatgttgtgcctgtgcgggtcacattgaacttgtttgtcatagtcaaaagcggctgttcatgtccgtccggaagaatctgccgccatatgctggctgtgtttttatatgtatatgcaatgttcgagcgagtgggtacttttacagagcattggctggagagggaaaagcttgaggaaagcaaagagctcgtccgccgccagtttcaggaaaaggtgctgcctaatgaagaatcgctttcaagctggcttgctttttttgattcagagttttctctctggcaggcacgtacgccagaaggcagccaaaacatgcagggcctctattacggctacctgtccgcattaaaaaaacatgcgccgaacaagccggagctgaaaagcctgtatcagattcattccgcgattgcggtttggcttcgcatgttcacattgattgaagcgggcaagctgaaccccgaacaagatttttattccctcaatccgtacgttgaacagctgatggatacaatctacagctctattgacaaattaaaaacgtacgcgctgtcttttgcgcttgatccgtttttggataaaacaccggatgttatccgacctttgctgttgaaagaagaaattttccaatatgaacgcatccgcgtcttcggtgaaatttggagtgcgctgttgtcgcggccaaaatgggtggcacgcgaacaggagatattgaaaaaagaagctggacggcgtttttctcccgaattgcaattcgggcgcctgcatttggaattcctgcaaaagaatgatgacgttatttttgcggaagcggatcaattcccgccggaagcgctcccttatacgttccaatggctgagtgaaatgactgccaagaaggactggaaacggcttaaaacatggtaccagcaaattgagccaattgcgatgggttatacgaagctggataagccgtttaaagagattcgcgatgtgatcggcgagctgttccttctgttgaatgcctatgtgcagcaaaccaatgatcaagcgctgtttgagcgctttgccgcgggctgtctgccgtatacgttcacagaatacagccatcatttatatgaaaaaaaacgctatgccgagtggattgaaattcatagccttgtcggcttttccatcaatgaaatggataaaatgatgctcaaggaaattgcagcgagcgaccctgaggcgcttataccggcttaccatagagaagtggcttttttcattgatcagaagaaccgcagctcgtacaaggaagccgcccggtatttgaaaaaattgcgcaccctgtacaaaaaagcgaaaaagcagaaggtgtgggagcggtatattcagctgctgagctcgcattacaagcgcctgcgtgcgcttcaagaagaactgcagaaaggaaagttgattgatggcgagtcttaaagaaattctcatccacgtcgaacaaatggaagatgggtcatttacgctctcagcctttgatgaaaatgagcagcctcttccctacagccatatgaaaaagcatttgttccaatggcatgaatcctcattttacggaacctttctagaggatgtcagcttcatcgggacgactgctgtcctgctatcgccatggatgactgtagagcttctcggcaaaaactcgttcaactcattcagctccgtgcagcttacagaagaaacggagccgctgatcgaggcggcatcgaccatctatgaatttatcgcggacggcgattttctgcctgactatgacgcatggacaaacggtgtttttcgctggaaagaccgcgataatatactggaaggctttactgcggaatggttttccgctgccgtacaggattacatccagtacgacgatgacctgcgggagaaatgggaacatatcaaggaaaaatcgcctgcggttacgacattccgcggccattttcttgatgaagaggattttctggaaggcattggctggattgacgatcaatctccatttactgtcggcttgcgcttaaatgaaccggactttgacggagacgaatggaagatcgagatgtttttacgcgataaaaagagcggcgctgtagaattctttgacggactgaagagcctcaaaaaatcgtggcaggcgtacagcgataaaatcgcgcgtgagcaggaccgctttcacagaacggttccgtggctgtcgtttgattccgggacaacgctgatctcggaggaagaagcctggatcttcctgtcagaagcaagtgagacgcttgtcgatatgggggtagaaatcctcctgccgtcctggtggcagattgtcagagacagcaacatgatgctgaaagcaaaggtgtcgtcctccccgcgcggcgagtcatttgtcggcatgaatgcactgcttgatttcaactggcggttcgcgacaaatggaattgaactgactgaggctgaatttaatgagcttgtcgccagcaacaggcgccttgttaatatccgcgggcaatgggttaaaatcgatccgcagtttatcaaacagatgaaacgcctgatggaaaaagcagaatcagagggactccacatgtctgatattctggcgcgcgagctaatggatcagcaggatggcggacttgaggattcggacctgattgatacatctgcttttgccggcattcagtttgatctgtctaaacagctcaggtcactgattcgaaagctcactgccgcggaaaacctgccggagcacgaagtcagtccttctttcaaaggaacgctccgcccttatcagaaatacggcatgaactggctgctgtttctgcgggaaagcggttttggcgcctgtctagctgacgatatggggcttgggaaaacgattcaaatgatcgcctatttccttcacgtgaaggaaagcggccggcaaaaaacgcctcatttgattattgcgccgacatccgtacttggcaactggcagcgggagcttcaaacctttgcccctgatctgtctgtcgcgctccattatgggccgcgccggccaaagggtgatgatttcgccgcgcattatgaaaacgcagacgtggtgctcacttcatacggtctgtcacatgccgatactgaagagctttcttctgtgacatggaacacgatctgccttgatgaagcgcaaaatattaaaaacgcgcatacgaagcaatcacgcgcaatcaggaagctgaagggtcttcatcatatcgcgctgagcggcacgccgatggaaaaccgcctgactgagctgtggtccatttttgacttcatgaataaaggctacctcggcagtttgaccggcttccataaacgctatgtgctgccgatcgaaaaagaccgggacgaaaagagaatcggacagcttcagcaattaatccggccattccttctccgccggacgaaacgggatgaagaggtcgcgcttaatcttcctgagaagctggaagaaaaagaatttatcccgctgtcagccgagcaggcatccctttatgagcagctcgtcaaagacacttttgaccatatgacgtccctgaccggcatgcagcgaaaagcgctgatcctcagcatgcttggacggctcaagcaaatatgcgatcatcccgcgctttacttaaaggaagagcaaaccgagctgctggccggcagatcagtcaagctcgaaaaattgctggaactgatgacagcgatccgcgcccaaaacgaaagctgcctgattttcacgcaatacattcagatggggaacatgatgaagcggctgcttgaaaaaacgttcggggaacctgtgcaatttttaaatgggagtctctccaagcaagagcgggatacactcgttgagaaatttcaaaggaaagaatatccgacactgattctctcactcaaagctggaggcaccggacttaatttgaccgccgccaatcacgtcatccattatgacagatggtggaacccggcggttgaaaatcaagcgactgaccgtgcataccgcataggccaggagcgctttgtccacgttcataaaatgattacgacgggaacaatcgaagaaaaaattgatgtcatgcttgaatccaagcaaaccctgaacgatcaaattatccaaagtgaaaactggattaccgagctttccacacaggagcttgaagaactgtttacattaagcgctacagcgcaatgatcatgactaaaaaagctggctctgatagagccagcttttttccgttcatagccgtcacgccgaatctccaaaaaatccgttacgccggttatatcaacaggatgcgcttttggagcagcacatatacctacagcaaatgtttcatcatatgtgcgacaccatgttcgtcattggttaaggtgacagcatcggctatcgatttgatgtcttcccgggcattgcccatcgctacaccttttcccgcagcctccagcatcgatttgtcatttaaactgtcacctacagcagcggtttcctcgagcggaatattcagctgttttgcaagcctcttcagcgcctgccccttggaagctttgcgggaagaaagctcaaagttgtgctcagccgaactgacaagcgtcaaatcttcggcatgctcatatcttttccagcctgcctcaagcttttctttgaagaaagaaaagccgagaatattgtaaaaatcgattggctgatcggcttcaaacagctcttgaaaagagttaatgtaagcaaagcccgattggctgtattgcacctcggccgcctgcttaaggacagaaagatccgcttccgggtttgcgcttctgaatctgtccagctcaacatcaagaagttctctgccgttttgcggtgtataaatcgctgaacctgtgaatacctcataataatagttttccgactcaagccatgagagaatatcatacgcccgtttcttatcaatcgtttcgtgatgataaagcctgccgtcgggatcgtgaatgacggcgccgtttgcactgatgacccatgttttgatccccagcggttcaaagattgacatgacgtcaaaatgagcgcgcccagttgacaccaccacttcaatgccatcccgctgcgcctgccgcagtgcgttttcattttccaagcttacctgatgcttgctgttgagtaaggttccatctaaatcaatcgcaattaatttcacgtttgtcagtcctttccttcatcctgctctgtcacgagaagctcaacgccgtttcggtcaagcaagtcacaaaatgcctgattcggcagcctgtctgtaatcaaaaggtcgatttcattcagctccgcatactgataaaaactggtgctgcccagcttcgaatgatctgcaagcgcgatgacctgctttgcctgctgtatcattttccgcttcaccatgccatcctcttcatgcgcaattgtaatgccatgttcggaaataccgaccacaccaatcagcgctttatcaacatggtagcttgagagcttttcaatcacagaggacccgtacagaaagcggtgctccttttccagcttgcctcccagcagataaatttcaattccctctttatcggacagcacatccgcaagattaatcgaattggtgattaccgtacaatcaaccgcattcaaatgctttgcacatgcttgaacagttgtagaggcgtctaaaatcacccggtcaccatcatgaataagcgatgctgcaagcctgccgatcttatttttttcctcagacactgttttcaggcggccggaatagctttgaattttctgatgcacagtcggcaaaatggcgccgcctcttgtgcggatgatggcattctgttcctcaagtttcacaagatctcgtcgcgctgtatcccttgacacttgcaggagcgtacagatctgttccgttgtaattcggttatgctgttttaaaaaatccaaaatcgctactaatctttcttcttggtacacgccctcattccttttctcagcaatcatttataagtaattataagtttttatttaattctattcaacattaataagtgattttaagtaaaaatacgtcgagagaaccaatttttcctaagtggacaaaaagaaagaaccagtctggtcgactggtcaattttgaggggatgatgcgaagattcggataatggtgaatggatagataacgggaggagcaaggggtgtcaatcagcagctttttcccggggtttagggtccataaaacgaacagtgtcagccaacacttctgttacatacacgttaacgccttccgcgttttcatagcttcttgtctgaatccgtccgcttactccgacgagagaacctttttggcaatacaacgccgtgttttcagctgtttttctccaaagtgtgcaattgacgtaatcagcttcgatttcacctgaagcattcttgaaactgcggttcaccgcgagcgtaacatgtgcaactgccgcaccggcggaagtgtagcgaagatcaggatcttttgtaagacgtccgacaagcatgacctgattgaacatgcgattcctcctctccttgcggttgtatgtattgtaaatgatgcaacaagaaaagaaaaacgcttaaaaatggctttcagcctctgtttttatctttcgttttcatttttccttcagctaaaaacatcttttgctttttccctttgaagaaatatgtactttttaaaaaacggaaaaagatttgctttgtcagccagttttgcgtattcatgcgcacataggaagagccatcccacgcaaaccactgaaagctcaattttttttccggcattgacagcttgattttatactgctccatgccatcttgtgtttcgtataaaaaacttattcttccttttttgttcagatgaacctcaaacacttctttacggcttaacatatatgttacttccttttgaatcaaatggctttcagaaggagcgccgtcaatataaatttcttttaaacgaaattgattcataccacatctctccgtaatccatagtcagttacagtataatgaaaaaatagaaattattaaatgtttcgctcatacaaaattctttagccccagcattgcaggattttttcctcgaaaacgtttatgttataatggaaggcaagaaaactttggaagtaatcggggtgagaagaaatgaaaacctttaaactggttgacctgaatgtggaacgagtggacaaggaagaacaatcaatcgaacagtttccccttattgacggactgattataaataaagaagacggtgaaaatcactggctgattgaggcgcttgtacagaaagaacatctgtctttttttgaacagcttcaaaacagccaatctgaagccaaagtatttgtaacgatcacgaaaaaaagcaatcgccccgcccagctgacagcagcagtgaaaaatatcgtcaagctggaagaaagcatccaggttttactctatggacaaatggtaacaagaaaacagcagggcactgaaaccattctcgagtcccttgtaaaagagggctatacaggaacaaaactcattgaggcatttaaacaaaagttataaatatgagggggcatgttccccaaaacagacacagaaccgaagagcatcacaatagacatttagaatagatatgttctgcatgaaaaaagctgccgttttgaacggcagcttttctcttcgtgctttcactcttgcatatttaatttgtatggccaaaagaatcaaccaattcccctttcacaacaaggcgcccttcagttttgacagccttgtcacatgtgattagcgtaatctcttttttgtttgtctcctcaactacatctgcatccgtttccgatatgatgtctttagatgttacagaatagatataatcctttttaaaatccgtgatgacaatttgggcacctgtttttatattctccagaggtccgaacagaagattcttttgcttcaaatgatggcccgccaacggataatttccctcacccattttttgatccgggcgcattgttgccgcccctatcaaaagattttcattggttgtgccttttacgatcggaagctccagatcgacacttttaattgttatctgccgccttgattgtgaagtaaaaataagtatatttcacgtgctttcgacgttctccacttgactggaatgctttaatggcgatcccggcatctgtagcttcaggctttccttcagaggaatcagaaatctcaaactctattttctcagtgttcagcacataaccggctggcgctttcgtttcaacaaaagcgtattgtcccggtgcaaggcctgaagctgtgactttatgatgccggatatgactggtttcgaagtctgtatgaaaattcgcgaacgattcagcatggtggatcttccggttctgatcattacagctgccattatcggccatgacaaatacaaggcttttcatgccggagcgaatgacattttgcaaaaaccttatcattactctgaatttatggcgcgtattcaaaacctgatcatgatgaaacatacagcaaatcaagccacaagaatggaaatggcgtttctccagtcgcaaatcaagcctcattttctttataatgtattaaacacgattatttctctcactcatttggatattgaaaaggcccgggaggtaacagaggaatttaccaactatttaagaatgagttttgactttcaaaatacatcagccatcagttccttcagacatgagctttcgattatcaattcctatctttctatagaaaagacgcgattcggtaatcggcttgaggttcttttcgatatagatgaagacattgactttatccttccgcctttaatgattcagcccttggtggaaaatgccgttcttcacggtgtcagcaagaaaagaggcggaggatggatcaaactgacagctaaaaaacaaagcaaaaatgagtatcacatcaaagtagaggataacggtgcggggatgcctccggaaaaacaaaaagatctcttatctgcggatttcgatcgcagcgtcgggttgaaaaatatcaatcagcggctgaaacatttttgcggaagcgagttgatgatcatcagcactccggatgcaggcacctctgtctcaatgctcattcatctcgctgaaacaacagaaagccccgcgggactgaaggacatagaacgaacctaaacgaaaattgagataaaaaaaagacgccgtttataacggcatcttttttattccggcgactttgcttgctgcttcagcaggtctctgatttctttcagcagctcctcctgcgcatccaccgcttcctccgcagcctcttcttctgctgcttcttttttgcgccttaacccattcaaagtccgaatgacgataaaaatggagaacgatataattaagaagttcacaatcgtctgtataaagctgccatacttcactacagcatcgccaaacgtaaacgacaggcctgaaaagtcaagccctcccagcagcaaaccgaccaaaggcataatgatatcatttactagagatgtgacgatctttccgaaagcgccgcctatcacaacaccaatcgcaaggtctacgatattcccccgcatggcaaaggctttaaattcattccacatacaatcacctgcttttctatatttgtaaagaaaaaaagacaaatgtgccgctggccatctgccttttttcaattattctccgagggcaaaagtcagttctacttcgcaaacgacttcgccatcaactgtggcaacgccttttccgcgcccgattgtgccgcgggcacgaatgatttcaacctcaaggtgaagctggtcaccaggcttgacttgttttttaaagcggcagttatcaatgcctgcaaaaaaagccagtctgccgcggttttcttctttaatcaacatcgcaacagctccgacttgagcgagtgcttctacgattaatacgccgggcataaccgggtactgaggaaaatgtccgttaaagaactcttcattagcggttacatttttatagccttttgcccgtttgccctcttcaacttccgtaatccgatccacaagcaaaaacggataacggtgaggaataatttctttaatttgctgagtatcaagcattgtcttgacatctccttcatctgcattagtatgtatagcaatcatcaaagatccaatctgtacatttgaaaagtatattatgaattaatctctttttcaaccgcgctaaaatgtaaccaactgtcaatgagagccgtcaaaagttatgatatgataattatagattttaccaatagcaaagaggtaggaaaatgatttcgaagtttattgaaaaaagaatgctaaacatgttagacgagtggtattccgcaatgagcaaacgcaaaatgaatcacgtttgcacactgaaagagaaaattgaccagcaccttccaaagatcaaaaagaacacaaaactttggatgcgttatcaattgtttcaggcccgccatcagctgctttttgaaaaccagaacggactcgattcattgttcgatgacctatatggcctggaagacaaaatggatgatgaattgaaatattatctgtattttttctctgggttatatgagatggtaaaaacagctccgaaacatgcagtacatcattttaaaaaagctgaacagtacctggccgccattcaaaatacgtttgaagccgctgatttatattatcaaaccgccggcgcctattacttgatgaaatcaccgccgctttccatccaatacgtcaaaaaagcattacacatctatttgcaccaattcggctatatcaaaaaggtaatcacctgtaaacttttgctcgccgtgaattatattgatcaagaacgctatgaaaaagctgaacagcttttcaaagaaatcattaagaaaacccagcaactacatgacgaaaacctgctatgccacgcttattataaccttggctttttaaaagcgaccgagaaaaaagaccaggaagcgcttctttactttagaaaagtattaaagaatcaagaatttgaaatgaattcaccagtctcatatcttcattgtgtgtacgagtctgtcagagcgctttttaaaacaggaaacatcacagaagctaaagccgtccttcaaaaaggaaaagaattatctgaaaaggtagacattcaaaccatttatttaaaattaaaaacgcttgaagccctctacacctcagtggaagatccctatgagcagctgctcgaatatgtgcttgaattagaaaaaatcgaggcgtgggtggatttagaagtgctgttagaagatattacggaatactacaaaaaaaaggacgatttcgaaaaagccgctttttttatcatgcgcggctgattgaaaaacgcccattttcttattatctgactgaattgattaaaccgagcatttgatctcccattgtgatcgttctgctgttcagctgatatgaacgctgggacgtgatcaaatctgtcatttgttctgaaatatcgacattggacatctcaagtgagccctgctgcatgccgatgttttgtctattagcgccgtttagctcttcaaaagctgccgcattatcaatagagaaaaggttattcccttcggatttcagctcttgagggttattcacttggacaacgccaagattaaaccgctgaaccgcgtttccgtcagatgcggttaaggtgccgttcttattgatggtgatattcttcattgagctgtcgatgttcactgtattgccgttctcatcaagtacgggatacccatttccagtgacgagctgcagctggttggcattcgcagcggacggcgttacatacagcgccccgtccctcgtatactggcggtttccatttacatttacctgaagatactggtatggagacgtaaatgcgatatccagatcgcgatcggtcttctgaatgcttccttgatcagagaccaggcgtgaattcatcatcgctccgacgccaaggcgtaagccgggcggcgttttgcgggcttttgccacttcctcgtttttttcatcaacctgatcgaattgctgtctgacaagctcagaaaaattcgtatcttttgccttatagccggttgtgttgctgtttgaaaggttgctgctgattgtgtcaatctgctgctgcagctggtttaaggttgttgatgccgttagcattgacctgagcatagttgatgtcccccgttttttcttccgttatcttaaatttttccaatttcatttgctgctttatccatacttttatcgtaagcctgaataaccttctgattcgcctcaaacgatctgtacgcttcagtcatttctgtataggcgcttgtcacatccacgtttgaaagctctgagacgccttgttttaatgaataggatacctgattgtttccggctgcgcttggcagatcattaccgtccgccgtgctgtacaaatcatttccgtcccgtttgagagtgcggacatcttccgccattctgacatcaatctggccggctgtgcgtccgttcgttgtcacagtaccgttttcagacacagtaaaattctcattatcaacagtgattggctggcgatccgtcgataaaatagggcgtccgttgatcgtcagctggttgttctcatttagtgaaaatgtgctgctttttgaataacggattccatccgctgtttgaaccggataaaaaagagcagctttttcattggtttccgcattcatcggaacttgattttcgatcaatgcaatgtctgtaggctgatctgtggacttcaggcttccctgtgtgaagagaggcttgagctcctgcatatacactccggtattcacggaaccgatttccgtcctcgatgtcccggccggagattttgattctattctgctgagcagcatttcagggaacgcgcgcatcgagccttgatcagctttatatcctgatgtatttgcgttagcaatattatttgaaagcatttccgttcttcgctgctgggcaatcattgcggatgttgctgtatataatccttttaacaaatttcccacctctaaaaatggcattttttccagttgtcatataggaacgttcgttctataataaaaactcagtattttatcctattatcgtcatttaacatcttttcgtgaaggctttttcataaaaaaacctcattctttttcagaatgaggtttgtgaaatcagcttagtttgcgtttaggaagcttgtccatattatcaagcatgacacctgtgccgatggctacgcaatccataggattttcagcaacgaggaccggtaccttcagctcttcagcaagcagctggtcaaggccgtttaagagcgcgcctccgccggtaataataacgccgcggtcaataatatcagcagaaagttcaggcggtgttctttcgagcacttgttttgcagcctgaacaataacagcgacagattcacgaagggcttcttcaacttctttactgtttactgtaattgttcttggaagaccggaaaccatgtcccgtccgcgaatggaaatttcctcgtgacgtgcgtctgggaaaacagttgcgactttaatcttaatatcctccgcagtacgttcgccgatcagcagcttgtactcgcgtttgatataatttaagatttccatgtcaaacttgtccccagccattttaatagaagaggaggtgacaatatcgcccattgaaataaccgcgatatccgtcgtcccgcctccgatgtctacaaccatgttaccgcttggctggaatatttccatacccgcgccgatagcggcaactttaggttcttcttcaaggtacacatgtttcccgccgcttttttctgcagcttctttaattgctttttgctcaacggatgtaatattcgtcgggcagcaaatgagcatgcgcggctttgagaacaggccttttacattcagcttgttaataaaatgtttcagcattgcttctgttacttcaaagtcagcaataactccgtctttcagcgggcgaatcgcaacaatattcccaggtgtacgtccaaccattcgtcttgcctcttcgccaaccgccagcactttgccgctgtttttatcaagtgcaacaacggaaggttcattcagaacaattcctttacctttaacatggatcagtacatttgcagtaccgaggtcaataccaatatcccttgcaaacatctatttatatcctccttgaaaatctgtttcacagtaaatatccacattgtgccctaattatatatattatcataaaatatagaaaaaaagttggaagcacaataagttctttacaaatttttgcggatgttttatgaacgatttcaagaaggcaatgccaggtgattacgattgctgaacaggctctccttcgagaatttcatcttttttatatttgagctttgtcgcttctcctcctcttaaatgcctgatggatttatgataatcgagtatttctttcacttcgtttgccaagtcggggttaatttcaggcagacgctctgttaaatccttgtgtactgtacttttggaaacaccaaattccttcgcaatgacacgaacggttttctttgtctccacgatgtacttccctatcttgattgttcgctctttgatgtaatcgtgcacaccactcgacctccctaaaatggatgtgagaagtgtgaaatgagatccgtattctgtaaagagtcgttcattatgccgcttcttcgttgtatggttttaaaagtaagtttgtgaaatatgcccacgatccctcacctcaaacactctctttgttaggtttgtaacagtgtattagcattcttttgggaatatgctaaaaactcaataaggacaaggggtgaaacgaactttttcagattcagcaaactatttcgcgtcactaaattttcatctttacaactattgatcgctcctgtaaaatgaaataagcaattagttacttaggtaagttttttagaaggagaccgacatgtcctacgtcaacagacacctcattcatcaaatcaaccaaagcgcccgcctgattgccaagaaagccaatgaacagctagagccattcggcctttattcatctcaatggtcagttttatattgtttgcgtacgatcggaccaatgactcaaaaagagatttggtcctatttaaatgtggaagcgccgactgtgactcggacgatcaaacgcctggaggagaacggctgggttcagagacggcaaggtgaagacaaacgggaaaaacttgttgtcctcacaaaagaagccgagaaaaaatacgaagaaatcaatgtgaaaatgttgaaattcgaggaagagctgcttgcagatttccgggatgaagataaagaagctttttctcatttattccgcatgtttttacaacaatgaaaataaggaagtgacatacacttgaaaaaagcggatgcgatatggaccaaggattttattatggtcctgcttgtcaatttatttgtgtttgtgttcttttatacatttttaactgtattgccgatctatacactgcaagagcttggcggcacagaatcacaaggcgggcttttaatcagcctgttccttctgtctgcgatcattacacggcctttctccggagccatcgttgagcgtttcgggaagaaaagaatggcgattgtatcaatggcgctcttcgccctatcatcttttctgtatatgccgattcataacttttccctgctgctcggattgcggttcttccaaggaatttggttcagcattttaacgactgttacaggtgcaattgccgctgatattattccagccaaacggcgcggtgaagggcttggatactttgccatgtctatgaacctcgcaatggcgatcggacctttccttggtctgaatttgatgagagtggtaagctttcctgtattctttacagcctttgcgctgtttatggttgcgggcttacttgtttcgttcttgataaaagtgccgcaaagtaaggacagcggtacgactgtattccgttttgcgttctcggatatgtttgaaaagggcgcactcaaaattgcgacggtcggtttgtttatttctttctgttattcaacagtcacatcatatctgtctgtattcgccaaatcagttgacctttcggatatcagcggatatttctttgtttgttttgcggtgacaatgatgattgcacgcccgttcacagggaaattgttcgacaaagtcggaccgggcattgtcatttatccatcaatcctgtttttctctgtcggactctgcatgctgtccttcacacatagcggcttaatgcttctgctttcaggggcggttatcggtcttggctacggatcaatcgttccttgcatgcaaacattggcgattcagaaatctccggctcaccgctccggttttgcgacggcaacgttctttaccttctttgacagcggaattgctgtaggatcgtatgtattcggattgtttgtagcatctgccggcttctctgccatttatttaacagcggggctgttcgttttaattgctctgcttctctacacgtggagccagaaaaaacctgcagaggctgaaggaaaagtgtctattgcagaataacttgtcagactgccgggaaatcccggcagtcttttttccattaaaacacggcgccctctcggttgaacgagagaacgccgcttatagcaattattcaatgacaggccgcgcaggtgaatcaggatctaacgaaaaatcataggacgcttcatcacgaaacatcggatcggcatatatggattgttgatcgttttttgttgcttttcgatacgaagaaaatgaatcatattctttctttttccacatccatatgccgtcttgatccgcttccttgtggtacacgttatgattgaccgtattaccttcgttttctgtaaagtcgtttccgataaataatctggaatcaccggccgtcaatatattcttttcaattgtgttgtttttcgtatcgtactgcagcagcagctgtccgccgtacagtccctttgtgtcattccggtacataatattgcgggcaatcagagaattgctggtgccgccccgctttttgtcatatcctccgattgaaataccggtgtacgcattgttgtacactttgttgtctgtgatctgaatggcatttgcatactttcctttgtgttcagacgttgcttcaatcccaatatcgttatcgtaaactgtgttgttcttaatttcgatatcgtgtcctccatcgacataaatcccgcccgctgagtattcatctccataagcaggattgccgtaagtcgagttttgataaactgtattgttttctacgactccgtttcgcacgtaatcgtttttatccgcggttccctcataaccaattagatcaatcccgatgttattattgttgcggaccacattgcctgcaactgtgaagccgtcgatattaccgttcagcacaactgcttcactcgctccaagcgtcagtttctcaactgtattgtcctcgattcggatgtctttcatgctgccagtcccataaactgcgattccgtgagcatttccttcatccgctgttgtcttaatcccccggatgtgattatccttaatggcgatatgactgctggaccctgatacataaatccctatagcagttgcttcctcagatgaaacagaaagatcttgaattgttaaaccgctgatggcaatgtcatgtttatcgtgaatacgaataagcggtgtttcatattcagcgttcgcaacggattcaccgctaatcacgacgttttcattttcatagtttcggaatgtgataggctttccgtccgtaccgctgtgctttacatcaagggtctcatgatacgtgccctcccgaatcatgacagttgtgccggcagcagccttctcagatgcgtgtgccaatgtacgaaacggcttttcttttgttccttcattttgatcactgccatttggcgaaacatacagataatccccagatccttcctcattcgcttttgtcttatcataaacgaaagcgaggatgacagacgttaaaacacccgccaaaagaataaaataccattttctcattttcgattcccatttcgttttagaatagatttctaaaaccattataaatgttctatttatggaaaaccatttcaaaaatatgaaaatataccgtctaaatagatcttattcagcctggcggacctgcgcatgttcaactgtttcaattgccaatgatgcaggcgggtgaacacgcatcagaacaatgtagaaaagaaaggaaatcagcacacctacaaaccaagaaatatcgtataagctcttcaatacaggaacatacatgccaatcagcgaaatcagcgctcctaacattgtggctgcaaacgcacggtaattgtagcccttccaatacacataccgtcctgtttcggaatacaggtcatctaccgagagctcacgtttgcgaatgataaaatagtcggccatcatcacgcctgccaccggtccaagcatgccgcctattaagccaagaaacgcatacacgcttgtcgcgctctccatcagcttccacggaaccgtaaataaagcgagcaacgctgtgataaagctgccacgtttgaaattgatatatttcggcagggcattcgctatatcataagcgggtgatacgatattcgccgcgacatttacagagatcgtggcgatgcagagtgtgatcacggacaagacgatgacataagggttatcaaaccgcgccaaaatatcgacaacatcccaaatcggctctccgaacgcgacctgcgagccggaggtcaccgtaatacttgcgaatgcgaacagcgcaaacgttcccggcaaaccgtaaaattgtcctttgatttgctctttttgtgtttcagcaaaccgtgtaaaatcaggtatatttaagatcaatgtcgcccagatgccgatgatgccagtaactccggcagcaaacggccagaatgtttctgaaaacgtatgaaactttcctggttgagagtatatcgggcccaatcctccagcaatatcaacggcccaccataccatgccgccaaataccagatacactaaaggccctgcccacacctcaaaacgtttaatcgactccatgccgtgatgcaatacgagtaaatgaatggcccaaaagaatacaaaggaaagcaaaccggacaagtgaatgccgagaatgttccactcgccgccaatttctccccaacctggccacatattcaaaagcaaaatgttcagtgccgtgctacccgcaaaggtctggatgccaagccacatgatagctgtaaacgcccttagaagcgcggggatattcgcgccgtatatcccgtaagaagcccgaatgatcactggaaacggcagcccgtattttgtccccgcatggccgtttaaggcaagagcgccaaataggataagtgatgccgtaataatgatcgccagcacctgccaaggcgaaaggccgatcgcaattaatcctcccacggtcgcgtaggtcggtatgttatgtatacatcccatccaaatggaggcaaagttcattgctttccacgtccgtttttcctgtcccaaaggcaccagatcttcattgctcagcctgttggattgctgctgactctcttttaatttcatagccggctcccctttccatattgtctatatgtcgtcacacgttatgttttttgacattagatgtcacttaatataactgaagagtcagacaataacactggctatgatatacaattttcccgtttgtatttgaacaacttaaacaagaaaaagagacagacctcagagcccgtctctttcttaagatgcagttttcattaatgcagcaaatctcacagccattaacaggcttgctccgcccgctataatcataatgattcccatcatatcaaaatgggctgccgtgatttctttaccaaaaagaatgccaaggatcaccgaagacaaaatcgatcctaggtaacggcaggtttgaaacaggcctgaagtcgttcctaccatgttggaaggactcgtttccagcatcgctgcctgaagcgcgacattgcccagtccgtagcctatacccaagagcgacagaatgaggcctttaccgatggtctggacattgataaaaaagatggttaagagcacggctccagccgtcatcaaaagcgctcccgcaaagatcggcttgacgacaccagatcggtcgatccatttgccggttagaggtgacacaacgatgctcattccagacataaacagcataaacaggccgctcgtttgaacagaaagatgcatttcatcctgaaagtaacttggcaaaccaaaaaataaacaatagaagaaaacattcaataaaataaactgaacatacacggctgacaggtttcgctgtgttttaaacagacggacatcaataaacggcttatccgttttcagctcgcgccagacaaacgcacagagcagaagcaagccaagcacaccttcaaccgcatgcggcgacgtgctgaacgacagcaaaaaggatagaaggaaaatgattcccccggcaaataaaacaattccaagaatatcgagctgccgaataatggttttgattcctgccccttttttctgatctttcgggaacatatacaggcccaataagaagctgaggataataaacggcaaattaacgataaagatcgccggccagcctccccatacaatcaaaaacccgccgactgtcggccccagcgccgtcatggcggacgcaaaaatagagagtacagccaaggctgaagcttggcgctcatgaatatgattccgaatcaagccgacacctgacggataaatcgcactgctccccaccgattgaaacagccgcatgaccaataatgtcataaacgtcggcgcaaacggcgccccgatggcagaaaccgcaacaagaataagcccgaataaaaacaagcgtttccgcccaatcaaatcaccgagctttcccgttacgggctgcgctacggcactcgccaagtaaaacgaggaaatcagccaggaaaccgttgtaaacgagaggtgaaactcatgctggatgctatggagcgcaagagagatcatagacgagttcagcggattcagcattgttcccgaagccacagctgttaaaaaaacagctcggctttttttcgataacatcatttcacttgttccagaaactcttccgttgtccgcgatttaccgattctcgggaaaataaagcgcagtgtggcttcatgctcttcatcgctaaatgtggacatggcatctgtaataaaaatctgctgatagccaagctgaaatgcctcccgtgctgtgctttccaccccgatattcgttgcgatgccgcacaatacaatcgtatcaatgccgcgacgtctcagctgcaagtctaaatctgtgccaaaaaaagcaccccattgccgttttgtcacagtataatcgccatcctgcacaccgatttccggaacaaattcggcccagtccgccggcatttcccctgaacctccctgcgcaggctcatccgtttgcggcttcagggcgtccgctccatcatgaaaggctacatttacaaagctgatgaacccgttatgtttccgaaattcatctacgagctttttcacgttcgggacaacctggccgctttgatcaatcggcacaatccccttttgtaaatcaatgataaccaatgctgttttttgaaaatcaatgttgagtgtattcatcatacgtctcctcctgatactgttagtgtttctcacattgcatattttactcttcacactgcctaagttcttttatgatgcttgtgaaattctcagaaggagcgttttctcatgatttttcttttatgtaatagtaacaggttgtgcatacgaacaaaccggcaagcacagtaatcataaggggcgtcatcacttcatcacctgcctgctgtctatcggttcctgcctgaaaatgcccatgaatttgcggcggtccatccaaagcaggataagacacataaccattaatatcgtgctaagatcctgcacgccaatgtcaaaacaatagttaatcaagacgatgttcacaataatgggcataaaaataaccgcccctaatgcagccgttcgcggaatcagtaataaaacagctgccaggatttcaccaaaacctataaacagttcatagacatgagaataaccgaaaaatgtccacgcgatcgtaaaccccttcccggcagccgcctcgatttcaggcgtcacctcgccaaactggccaattaccactttcgccagaccgtacacgaaaaaattaaaggctaaaaacaatcggaacgtcgcgggaatcgacttgcgtaccgctttcctcagcctgccgcctttcttcatcatacatccccctcagtgtattatttgatatagtacacttaatacagtatatagtattctaattaatgtcaattcccttttcagctcatatgaatagctgcttttatagatacaaagtcttatatcgtaaaaaatgtcgttctcctttctttccgtccctcgataacatttcttaaaaaccatgttaggaaatcttacacgaaaatgttttatcattcttttttctctataatgaagaaatataataattgctttttattctgaaagatacggaggaatgagacatgcaaatgggcgatacagtttttatgttcttttgcgctttactcgtgtggctgatgaccccgggattagcgttattttatggaggaatggtaaagagcaaaaatgtgctgagcactgccatgcacagtttctcttccattgccatcgtttccatcgtttgggtgctgttcggatatacacttgccttcgcaccaggcaattcaatcatcggcgggctggagtgggccggcctcaaaggggtcggatttgatccgggagaatacagcgataccatcccccactcgttatttatgatgttccaaatgacgttcgccgttctgactacagcgattatttccggggctttcgcagagcggatgcgattcggcgcttttcttttattctcggttttatgggcctctttggtttacacacccgtagcgcactgggtatggggcggcggctggatcggccagcttggagcgctcgattttgctggcggcaatgttgttcatatttcctccggtgtggcaggacttgttcttgccattgtgctcggcaaacggaaagacggtacagcgtcttctccgcataacctcatttacaccttcttaggaggagctttgatttggttcggctggttcggctttaacgtcggcagcgctttgactttagatggtgtagccatgtacgcgttcatcaacacaaacaccgcggctgcagccgggatcgccggctggatcttagtagaatggattattaacaaaaaaccgacaatgctcggagcggtatctggcgcaatcgccgggcttgtcgccattacgccggctgccggatttgtcacaccgttcgcttctattattatcggcatcatcggcggggcagtttgtttctggggagtattctcgcttaaaaagaaattcggatacgacgacgcgcttgacgcctttggcctgcacgggatcggcggcacatggggcggaatcgcaacaggattattcgcaacaacctctgttaactcagcgggcgcagatgggttattttacggtgatgcaagcttaatctggaaacaaatcgtcgccatcgccgccacttatgtttttgtatttattgtcactttcgttattattaaaattgtaagcctcttccttccccttcgcgcaactgaagaagaagagtcacttgggcttgacttaacgatgcacggggaaaaagcatatcaagattctatgtgaggagtgacgctatgagcggtcaaatgttcaaggtagaaattgtaacgcgtccggcaaattttgaaaagctgaagcaggaactcggaaaaatcggagtgacctctctgactttctccaatgtacacggctgcggccttcaaaaagcacatacggagctctatcgaggggtaaaaatagaaagcaatgtatacgagcgtttaaaaatagaaattgtggtcagcaaggttcctgttgatcaagtgacagagaccgctaaaagggtgctgaaaacgggatcacctggtgacggtaaaatatttgtctatgaaatcagcaatacgatcaacatccgcacaggcgaagaaggacctgaagcactttaatatcggtacgagattcggacactccggatctctttttttgtgcacagaatcccccccagaaaccgcgattcctcttcgaattctcttcaagcgccgttatttcagacaatctctatttttatttgaaacttttcatgagtaagattagtctactaaatataaaaatgtaaaaggtgattatttgaactacgaaatttttaaagcaatccatggactatctcatcacaattcagttctcgattccattatggtcttcatcacggaatatgccattgtcgcctatgcccttatcctattggcaatctggctgttcgggaacacacaaagcagaaaacatgtgctatacgcaggcatcacaggaattgcaggccttgtgatcaactatttgattacgcttgtttatgtcgaaccgcgcccgttcgttgcgcatacagtgcatacactgattccgcatgctgcggatgcttcatttccaagtgaccacacgacaggtgcattagcgatttctattgcgatgcttttcagaaaccgcaaaatcggctggccgcttgtcatttttgggcttttgacaggcttttcgagaatttgggtgggacatcactatccggtagatgtattgggcagcctcgttgtcgccatcattatcgggttccttttctttagattttcagatctgcttcgcccgttcgtcgatttggtcgtgaggatctacgaagccattatcaataaactgacgaaaaaaccaaccgatcaaaatttctaagaaagacaaaagccggcgtctgaaatcaagacagccggctttaatatttctcatacatctcttgttttcttcgcttcgccaacacatataaaccataaaacaacccaattccaacagcatcgatgagcacatcccggatacaaccattcctgctgaagaagagctgaagaacttctgtgaaaaaagcaaacgcaaatgagccggctgcagctgatcttatgctgccccgctgtttccacagcaaatatgtcagcacaaagaaggaaaacgcgtgtccgattttttgaataaacgcttcaggtacagtaagctcagtaaaatccataactaaaaattgagacagatcagggtgcggctgaaaatgaaaagccaccgtttgcgatacgaccatgccgctgaagctttccgtacagacagaaagcaggataaaaaagatccagcctgcgagcaataggcggttcatgacataacctcctttataacgtacgtgcctacatgtaactacatagacggtaaaacaaagcaaaaagtaacagaaaaaaacgcccatcacaaggatagacgttttcttcattaagactgttcagtgtcttctgttgtgctgctttctttagaaccagatttgtcagttgaatcatcctttttctcaccggatttttcttctgttcctttttcagttgatccgtcctttttctcggaagattgctgaatggattcttctgtttcttgggtggcagctttttcttcagcagctgctgctttttcaatagaagaaactggtttgtccataaagtttaacggattcattgcaaccccatctttacggatttcaaagtgcacgtggtttccgctgtcttcactgtaaaggttcttgccagattttccgatcacttgattttgttttactttgtcaccttgctcaacgcttacttcggaaagagattgatacacagtcgataaaccgtcggcatgttctacttccacaacatatcccagcactggatctttttcagctttaacaaccgtaccgctcagagaagcagagacatcgaaatcttttccgtctttctcagctaagtcaattcctttgcttaggctgtacgtgttattataggtaacgagtgctgcttctttctcttcttttgcggcatcggtttcatagaactttttcacaacagaaacgttttcagaatcaacaaccggcattgcgacattttccattgactttcctacttcaactgcatcgtcgttgttgtcatatgcggagtttccgccgttatcagccaactgatcctttacctcatcatttgatactgattgataccaaaggacagctgttaaaatgacggccgcactgactaagtaaattgcagggaacacccagcgtttacgaaaaaactgctgaagttttttgacttgagaagttttcttttcttcctctctcattgtttcatcacctcagcaacattctgaacacttttctgaaaatatatacaacctatccaaaaaaacttttttagatgtagtttgcacagactgaacgaaaatatgtatttttttgagaggagtgccaaaaacgtatgaacatgacattgcgtcttgctgaacatagagacttggaggctgttgtggcgatttataattcaacgattgcttctcgaatggtaacagccgataccgaaccggtaactcctgaagaccggatggaatggttttcgggacatacagagtcacgtccgctctatgtggccgaggatgaaaacggaaacgtcgctgcctggatcagctttgaaacattttatggaaggccagcctataataaaacagcggaagtcagcatatacattgacgaagcatgccgcggcaaaggtgttggatcatatttgcttcaagaagcgctccgcattgccccgaatcttggcatccgctcacttatggccttcattttcgggcataataaaccaagcctgaagctgtttgaaaagcacgggtttgcagaatggggactattccccggcatcgccgaaatggacgggaaaagatacgatttaaaaattttagggagagagctttcatgattagtctggataaagatgaaaacgaaattgaacatcataatgaagaaaatagccttgttgaacaggagactgcacctgttggacaggagagccgccagctgagcgcctccgctgtcaagtcgctatccgacattgccaagtggggcaaaatttctggcatcttgttaatcattatgggatcgcttgtcactctgtctgttttgatgacagtgattggcgccatcccgggcgtgctgctcattatatcaggcgtatttttgatgcgctcagcaaaagcagccgcggaagccgaaggaaatctagccggcagcgctggcgaaagcatgcttgaaaattacgggacatttataaaaatgcagctgttttatgcagcatccagtatcgttactgtcctgatcgggatcattgtagccattttcgtgctggtggtaatcggcattgctgcttttgagaacacgccttcgtatgatgatccggattcttattattatgaggatgatccggtgtttgaataatgatgagacaggacagggcatgagttccatataaacggaaccatgcctattttatttgactattcaaagcaggccggcgtaaacaccaaatcctgaagcaagtacaatagacatctctagtagaagaaatcaacaaagcaacgctgttacccagaaataaataacaaaaaaactacctatgaggtcggaatctatctgaaaccgcgctttttatttcgggtgtctgcatgcaaaaaaacacacccggatcgtctggaaaatctcaacaatccgggtgcagatcttctttaatacatttttttgcgtctgtcttcctcagtcaaaaattcaacaaaactccgcatcgcaaaaggctcttcctttatttgccgtgcgtaggagcttttccgctcttctgaaaggatttcgctctttttgatcctgttcagcatatagatgtgaactgttttttggatttgtttatgctgatagcctgcctctttaaaaaatgcgagcccgagcgccgccaaaagagcgaatatgcctgcgctgatcagggactccctgtcagctgaagcatgaaatagaaaagcagctaaattaaagagagagaatgcagcaagcggaatagcaagaaaacggtaaatgacggtttttttcatgaaaggctgtacggccttttgaattttttgcatttctgttttgatgaaccccggcatttgttcgactctgtaaaagttcatataatcctccccctttatttgatgtttcaagcttcacgaacgttacatatgtgtttattttaacgcaggtgcaagctggttttaaagaaatctgcccgtatttttcacgaagaatctggatcgccgctctttattcttttaaaatgtgagtgttataatttgtaatgggaatcagatcactgttattcatggaatactaatggcaatcttcttgataaatatgaatgagcggggttacaaagtgagtatttcttccatccttttatcactttttttcattttaaatattcttttggccatcattgtcatcttcaaagaacggcgcgatgccagtgcatcttgggcgtggctgcttgttcttttctttattcccgttttaggctttattttatacttattattcggccataatctcagacgcaagcatttgtttcaatgggaagaccggaaaaagattggaattgaaaggctgctgaagcatcagcttgaagatttagaaaccaagcaatttcagtttaacaaccgggcaacctttgataacaaagatttaatttatatgctgattatgaataaccatgctgtgtttacagaggataattcagttgacgtcattacagatggacgggataaatttcagcggctgctgagtgacatttcaaaggctaaggatcatatccatttacagtattatatttataaaggcgatgaattaggcaaaaaattgcgggacgctctcatccaaaaggcgaaagaaggtgttcaggtcagagtgctttatgatgaactcgggtccagaacgctgagaaaaaagttttttaaagagcttcgcgaggctggcgggcatgtggaggtctttttcccgtcaaagctcaggccgattaacctgcggctgaattaccggaaccatcgaaagcttgtgatcatagacggtatgaccggttatgtcggaggctttaacgtcggagatgagtatctagggcttaatccgaaattcggttattggcgggatacgcatatccggctgcaaggaacggccgtacacgccatccaaacacggttcatccttgactggaaccaagcttctcatcaccatacgctgacatatattccaaatcactttcctgattacggcccaaaaggcaacgtcgggatgcagattgtcacaagcggccctgattcggaatgggaacaaattaaaaatggctacatcaaaatgatttcgaacgccaagcgttccattttgatacaaacaccttattttatcccagatgcaagcctgctggatgctttaaggatcgcttgcctttcgggcattgacgttaacattatgattccgaacaagcccgatcatgcctttgtatactgggcaacactttcgtatatcggcgatctgctgaaagccggagccactgtctatatttacgataacggctttattcacgcgaaaaccatcgtggtggatgacgaaatcgcttcagtcggcacagcgaacattgatgtccgaagcttcaggctgaattttgaggttaatgcatttatatacgatatcaccattgctaaaaaactggtttcaacttttaaagaagatttgctagtatccagaaaattcacctatgaggagtatctgcagcgcccgttgtggattcgaataaaagaatccgtctcgcggctgttgtcgccgatcttataagatgtgcaaacccccggcctttacggccgggggttttcctgatggtcacagtaaatgatgatcgcctcccgcaaaaaagcggcaagaccttctccatattgattgattgaatcggtaaatcgctcgtcagtgatatacacttccccgagtcctctgaaaatgtcgagtgtgcaatcgtaatgatattggcaaatatgatcgcgaaatgcccccactgcggcctgaacctctgcatcatcgggcccatgcttcattcgcgccgcaattcgtctgtaaatcgaatcaaattcagccatgatcgagcgccaatcatctgccgagtatgcagatgtccttttctctgtttcttctgcgatttccttaccatacagctttctgacttcgtcagcgtatgtctgctgatgctcttcaatgtctttcatgcttaatccggcaaataaatccctcttattcatcgtttcccctccatcaacggacaaaagcgtcctgtcaattgtttgaatcatctcatccattctttgttttttcttcatcaatatctccttttgcgactgaagtgccgctttccggtcaaaattcggatgatccagcatctccttaatctcatccagacgaaacccgatttccttgaaaaataaaatctgctgcagtctttccaggtctgcgtcactgtacaaacgatacccagcatcagtaagcgctgaaggattcagaagctcaatattgtcatagtgatggagcgtccgaatgctaacacctgatatctccgccacttgtttaacttgatatttcatacataacacctcctcttttttatcgtaaacaatcacgcaacgttagggtcaatccccaaaatgttattttctatatacaaaacttctcacaaatagtgtataaaagaaaagtgagtatttttttgtaaaggggagccagtatacatgaatcctgaaacaatgaacaaaaccctcatcagcatttcgaaatggggaaaagctacaggcattttatttattattatgggcgcaattaccgcgctttcaggcgcgttcttttttctaatcggtgccgtgccaggcgtactgcaaattatttccggtatctttttgatgaggtcagctagggaagcaggccaaatggctgaacacaatagcggacagtctgaagacttaatgctggagaattacgcgaaattcgtaaagatgcaagggatttatttgatcgtaagcattgctgtatccattcttgcgattatcgccttcttcatctttttaatgcttgggattgctgacggccttttcagcgatacgtacagcacttattaatgagaaaaacccggagctggctccgggttttttattattccgcttcgcttaccactgtgaagcgttcatttttgtgttcgggatgttcaagctcgtccaacacggcaatggcataatctgcatagctgatatagctgtcgccttttgcatttacgatgacattgtcttttcctttttggtaagagccagtccgttttcctgctggatcaaaaaatgctgcaggactgaggaacgtccaggaaatgaagtctgtctgctgcaaatctttcaggttctctccttgatttgatgcagttggcaaatattctttcggaaattccggcgtatccattaaacgggttgttttggcttcatcaacaaacaggcttcccgctccgccaacaacaagcaatcttgtgcgcttcgcgtcctttaagatgttgatgagtgctcttcctgcttcaacatgaagatgttcttggccgggtgctgctccaaaagcgtttacgactgcgtcgaaaggcttgatgtcttccgcagtcagttcaaacacatctttttccaaaaccgctacgtcctgcccctgcacttttgaagcgtttctgacgatggctgtcacttcatggcctcttgttttcgcttctttcaaaatttcgtttcccgctttcccgcttgcgcctataataccaattttcatttttcatttcctccttatttgtaacaattttagttacatgttagcggtgagaagtcatcccttttgattaaaagagatgattcataacatcttttaatgacttgcttgccagttcattttccatcgctctttgcacactttcaaacgtttcatccagagcgttctgaatttttttccctaccggacatttcggattcgggttttcatgaaccgcaaagagttcttcttgcttttggacagcccggtacacttctaaaagagaaatatcagcaggatcttttttgaggcttgcacccggcacccctgcgcgtgatgtgagaatatcagcttttttcagcaggctgatcattcttcgcacaactaccggatttgtgttgacactgtcagcaatgatttctgaagatgttttttcatccatcgagatgagggataaaatatgaatggcaacagcaagacggctgttaatcatgttttttcaccaccgttgtaactataatagttacatttgattcgtttgtcaacatctaatatacactaaatacacgggttttgtgcaccgtttttagtcaatagaacggccggatgcactccggccgcgtcttatcaaaataagaaatatctttgtccaagtgggacataatcgacaggctggcaagacaattcctccccgtcagcaaagacctgataggtttttggatcaatctcaatctttggcaaagccgaattcagcttcatatccagcttgctcagctttctgatatttttgactggagaaatccttttttccagccctaagctttctgccacaccacgctctatgcttgcctgagacataaatgtaatcgaggttgagcggttggcttttccgtaagacgcatacatttggcgcatgaaaaccggttcaggagtcgggatggacgcgttcggatctcccatttgcgcacgtgcaatcatgccgccctttaagaccagttccggtttcacgccgaaaaataccgggtcccacagaacgagatcagcaagcttccctttttccaccgagccgacctcatggctgagcccgtgcgtaattgccggattaatcgtgtatttggcaatgtaccgttttgcgcgcacattgtcattcccgttttcaccggcaagagcgccgcgctgttttttcattttatcggctacctgccatgttcggatgatcacttcaccgacccgccccatcgcttgggaatccgatgatgtcatgctgatcgcacctatatcatggagaatatcctccgcggcaatcgtcgccgccctgattctggaatggctgaatgccacatcttcaggcactttcgcatctaaatggtggcagaccatcatcatgtcaagatgctcatccatcgtattaacggtataaggaatggttggcgttgtagatgacggcagaatgttcgcgtaagaggcgagcttcataatatccggagcgtggccgccgcctgccccttcaatgtgataagtatgaataacccggtccccgatcgcgtcgagcgtgttttccaaaaagcccgcttcgttaatcgtatcggtatggatggcaacttgaatatcagcctcgtccacgacttccatacacgttttaatggcgcttggcgtcgtgccccagtcttcatggagcttaaggccgatggcgcctgcttccacctgctcgatcagcggcgctttatcggatgcattcccttttcctaagaagccgacattgatcggaaactcctcggccgcttccagcatcctcgccatataccacgccccggacgtacatgttgtcgctttgcttcctgtagcgggtcctgttccgcctcccaaaagggtcgtcacacctgaagaaagcgcaacttccatctgctgaggacaaataaaatgaatgtgcgtgtccactcccccggctgttaaaattttgccttcaccggaaatcacctctgtccccgctccgatgaccatgtgtggatcgactccatccatgatatcaggatttccgctttttccgacaccgacaatccggccgtctttcacaccgacatccgctttgacaatgcctgtgtaatccaatagcacgacgttggtgataactaaatccaaagcgccgtccttccctgtgattctgccgttttggcccatgccgtcgcggattgtttttccgccgccaaagatcatttcttcaccatatactgtgaaatccttttcgacttcgatccataaatccgtgtcgcccaatctgattttatcgcccgttgtcgggccaaacagttccgcatattcctcccgtgacattttcatcggattacaccctccatccagccggcttgttttaagttggccaacgttttttctttgccgcgttcatcgataaacgtgtcggccattccgttcagccctttaattgtcttgcgtcctctgatttccactagtgagaccgttttctgctctcccggctcaaaacggaccgacgtgcctgatggaacatcaagacgcatgccgatcgccagctcacggtcaaataataaagccccgttggcctccgcaaaatgaaaatgcgaaccgacttgaatggagcgtgatccggtgttttttaccgttacctcccgtatctcacgcccttcattaatcgtaatggttccctcagcaatttgaaatgctcccggcttcatgacttcacctccgcagaaattggctgatgtaccgtaacaagctttactccatccggaaatgtggcctccacctgaatgctgtccagcatctcaggcacaccctccatcacatctttttccgttaatacatggcggccggcttccatcagctctgctactcccttcccatcacgtgcgccttccataataaagcaggtgatataagcagcagcctcaggatagttcagcagaacgccccgcgcctttcgctgtttggctaattcccccgctgcaaaaatgagcaatttctcttgttcaactggtgtcagtttcatctgtagtcctccttcttttgtcatataaagcagatgcggctactacgaatttgcggaacagtcaggcgggacatcacctccctttcttcgggaatgggggtcatacggtaagatgcctttcaaagcggcatgccgtttcttcatcagccttgccatggtcaacaaccgttcccctgtcgatcacggaaagatcagattaacgcgttttccagactgcgctcgactaagataacaaatgtctttttttctggaaatttctataataacttgtctgactagttcgacaattaaaatctgaattccttccaattgtttattaagtaaaatatttttcagatttaccatcagcgctctggcgattgcaagctgctgctgttggccgccttttcgctttgaacaaacgtttgattaaaataaatagcccccctgtttagccggaagcaggcctatggagtggatggccgactccatttcggcctaatacagcgacaatctgccccgggcgaagctaaggctgtgcaaaaccatcgattgatcataaccagacgttacattcctgatggcagcccgttgttttgctccgcaaccggaagtatggcatggaggccagtctgaggcgccgacctccacgataccgagaacccaactattgccattaactccgcatcatggacggtcacttcgctgatcgccaccgttcctcttaatgagtgaagaattccggccttcactgaatccccgcttgtgtcgatatcaactgttttctcgcactcccgtggcttccgacactttcttcggtgcagtacattcagccatcaaaacccctttgtttgatttcttcaaatgatgttataaaagtttacaacttatgtcatcattatatagaagaggcctattaattcaaagaatatttaaaaaatttagttaccttgaccaaatcagcttctttttttgttatatttattcacatcagaaaaagcgaaaaaaaaagacaagaaacatttcgtttcctgcctcttccgtacgattaatctttatctgaaaatttatccttggctttcccgatatccttttggatttcgccttttgccttatcttttttgccttcagcctgcatgtccgttctgtcagccatatctccgactttatccttcacttctcctttggctttattgaagccgcccttcattttgtcttttacactatcgttacccatgttaattctcccctctcaattatgtgtgtacttgttaacttcccgatctgagaggcaataaacattctaatgttatttatcgatttcgtagcgctctccgtaacggagcaccttgtatatcgccagcccgtctgatgactttttctccgaatatcggaccggcagcagggcaaaaaacacataatacgtagaaaaatagacaaactgatagaaaaacacattcggctttaatacactgtgtataatcagcagattgattgcaaaaatcgtgatgaggttaaacaagcagcctcctgcatacacgagtgcatttgagaatcgattgtcaattttcaactccccgtaccggcaaaaagaatcgataaaataaatcgttctgaaccgtatgggtccaattttaagcagcgtttttcccatgcctatatccaacgatccctttccgccaaaaataaaagccataaagctgtgccctgaaacatgtataatctgtacaagcggcagaacaatgaggaaagaccacagaaacttcaccatatcattaaaaccaaacattgaattccccctcacatgcatatctgcatcccaaaacggcttttgttcaaaaaacagtgctgtagcgatttttcctgttctccccggaaataaacgttccgatgctcccctttttttgcataaaaaaaaaccatctgccagcagatggttttgtctcatacttcatataaacaatcgttcctttgaatcatctctctcatgctgaccgctttttcataaaaatacaccgcttctttatattgttcgcgatgactgaaataagaggcagcatctaaagcaaattcttcaatatatacatacaggcccttttcttccatataatcaaatacttcttgaatcatatccaaattgacagattccacatataatgcctgcagaaatttatattttgccagactgaagaagtcgtttcgtttttgggcaatggcaatccctttttcatagtaccgtatcgcggcttcgctatcttgttttttgaaaagaacgcgagtcaggctgaagagcgcttttggaagctgttccagctgataatcctcgaagacaggaagcgctttttcaaagtattcggcggcctgatccagctcccccttgtcatcatagcaattcccgatattataaagggctgatccgatcaaacggggctgtccttccaataaagcaaggcgatacgcgtcatccaaatgctcaagcgctttttcataatttctgtagtctatgtagtttcctgatatgacgaaatggcattgaattcttctgactctataaaaatcgtgagccttatacgtctccagcgcctgtacagcgtggttcatagaaaagtgcgtctgcttcataatataaaagacttccgccactttaaaatgaaattccgctctttcaatttcatcttctacaaacgcaagcatcttctcagctttccgataaaaggatatagccgagatgtaattgttctgttcaaattcgtacattcctctaaacaagtgaaaataatactcagataatccggagatgctgtcctgattgctttccagcgttttgatcaattcacgatattgaagctgagattcctcgtgcaggtcaggctttacgtaatccagcataatttggtgccggtagctgatcagctgataatacaggagaagcagctgatcctcttccatctgttcgatatctagatcaatttcttctttcagctttacggcatcagccacttgaaatgctaaaatgtgcttataccacttattgattttcactcctacttgagatgacgggatctcgtacgcggccatgcccctccaaccctttctattttctaattggttatattttatcataatgtatggctttggaattaaattttcttacaatgattccttctttatgcctatccttatatatttcggtttttctacgtattttttgcactcggattctaataaaaaagcttaccggacagtgccgataagcttttgacttcaaattaaccgccaatataagacatttccactttctttttgccagatgcttttgatagcgtacgatcgactgaatactgatcgatccgatttttccatactgtcccgatcatttctgatagttcgtcatcacttaattcctggcgaaccggagctctgaggtcaaatccgcttgaagcgaataagcaggtaaacagctctcctctcgcagaaagacgggctctgttgcaagatccgcagaacgcatcagatacagatgatatgacgccgatttctccggagccgtccaagtagcggaatctggaagccacttcgcctatataattaggcgctatcggctcaaccggcatgtgttcattgatcaaatctatgatttccgcctttgtcatgacgtcttttttttcccattggttggtgttgcctacgtccataaattcaatgaatctcaggatatgccctttttctttaaaataacgggccataggcagtatatctttttcattgacgcccttttgaacgaccatattgattttaacaccgagccccgcttgcttcgccgcttcaatgccttccagcaccttgctgacagaaacaccgcgcccgtttatcttcttaaaacgctcgtcttctaaagaatcaaggctgatcgtaacccttttcagcccagcctccttgagcctcttagcataaacaggcagcagtgatccgtttgtcgtcatcgcgatgtcacgaatacccggtatgcgggccagttttttgattaattccggcatatcctttctcatgaggggctctccgccggtcaagcggattttttcaacgccaaatcttgtgacaaacaatgtcgcaagccgttccagctcctcaaatgaaagcagctcctctttctttaaaaaaggataatccgggccgaataattcggcgggcatacagtacgtgcatcggaagttgcagcggtctgtaacagaaatgcgaaggtctctcagcggtctgtttcttttatccaacatctgacgcgactctgtaatcatagctacagccccttcctactccctgattctctcagggtgtgtatatacattaaatgatccgtttctgacaaatccaatcgctgtgatattcaattcttcagccatttgaatcgcaagctccgtcggggccgatttggaaatgacaatcgacacgccgattttggccgcttttaacaggacctctgatgagattctgccgctgaacacaatcagtttgtcgcgtacggacatcccgtttagaaggcagtgcccgtatagtttatcaagtgcgttgtgccgaccgatatcggtgcgcatcaacagaagcttctctgtgtcgcaaagcgccgcattatggacgcctcccgtatcctgaaacgtcccgctcccttgctgcatgtctttcataagcgccagacatgcctcaggcgatatcttgatttggctgacagccgtcttggctgttttgacatcctgctgaaaataaaaatgacggccctttccgcagcatgagccgatcacccgtttcgtataatccttttgatccaatgtctcagggtgaacgaggtcgacatatacaaaaccgagactttcatctattgtaaaccttttaatttctttttgaaatcgtataacaccctctgatgcgagaaatccgatgacaagctcttcgatatgctcaggcgtacaaacgagcgtcacaaattcactgccattcagtatcactgtcaaagggaattccgtcaccatccggtcttctactttgcttatttccccttgttcatagcgccatacatccctgaccgcagttactttatcgttcaatgtctcttcccctccgcaatgttcctgcctttatattttttcacactcctcggattttgtcgaattctgagacacaaaaagagccctctatataaagggctttcacaggatgtgatgacggcggtgtttaggcagggcgcctaccgttccttttataacacgtgagcaccaatgtgcattgacaacaaacgcggggtttgtcgacacgctgagagccctctatagaaaggactctatggttgattatactgattcttttttagaaccgtaaacagcacaatagctgcgatcaaggtgagaatgctgacaaaaaagaaggctgccagttttagaagaacaccaagcaatatgaatgcaacggtggctataagaaaaatcattccgaataatttcatatgttcaacccctttttagggtatcattcccgcccaaactgtttttaaaccaataaaaaaaggcgcctgggggagcgcctgatctttaggttccttactcagtaaatttttgtgcttctttttcccaagcctgttcgaactcatccgcactgttcgctgaaatatattctccgccgccagcgacagctgcttgtttcatctcttcattacccttgacatcaaagttgaagccaatgatgtttacaatcgtatccacatttgatgcacggagcttttcgatttctgccgcagggtctccgccgcacgtttcttcaccgtcagtgattaaatacaccacgtttttcccgtctgcgtcaaatgcctcaaattcttttcttgtgtctgcaagtgctttggcaatcggtgtccatccagtcggcttgagctcactcaatgaattgtcaaacagggatccttcatatggatgaaggccgtaaatagtttccgtcgtactgcacgaaagggctttaccggacagtttattattccctgcatgcccgaaaacgcgaagcataagatttgtatccttcggaagaagttcggcaaaagattttactgattttttggcaatgtctattttgcgctctcctcctgttttttgaaccatacttccgcttccgtcaaacaaaacagctacatttgtatcagcctgtttctcagcggcaaaagacggggaggcaatggaaacagtcaacaatccaatgataccggcagccagcaattttttcatatgattacttcctttctttttcatattttccaactatatgttggattcttctttatgctagaatacgaaaatgcaaaaagatataggacatgctgccttttgtgctgctttcacgatctgtccaaaatcgcttgaaatgccgttcatttttagccatttccgcccagaaagcataaacagattgtgtgatcattcattcttttttcgccttgattatgacagaaaaacggaaatctgctactatgctacaggcagacagctaattagttttgaagtttttgttacatacaaaaagaggctgaccatcaccagcctcttttttcttatttagataacattagtgattgctgagtgaaaattttctcaacatctttttgggtataagccgggaagtattcaccgccgcctactttcgcaattgcgttcagctggcctttgtatccctctttataatcaaagccgatcacattaacagtgatattgtctttttgcagttcctttgctgttttaatcgggtttcctccgcacgtttcctcaccgtctgtcaacagatacaccactttttccccttttgcatcaagctggtcaaaagaagatttcgcctcgttcagcgctttggcaattggcgtccagccagtcggcccaattgtattgagagaattgaggaagctttgctcgttaaagctttggaagccgtatacgttgcgaatggcttcacatgactgaacttttccggaatttttattgtttccttcagagccaaacacgctcattttcacctgagttccttctggcagtgagctcgcaaactttgaaatttcttttttggctgaattaaatttagatacaccgtctattcttttcgccatacttccgctggcatcaagcaagaccgccacgttcgccggcgctttagcctccgtttctgacttttcagctgcaaaagcaggtgaagttaatccaaaaagcaatcctgtcatcatgatcagtgaaaatcttttcttcatgttcgtacccctttaccaatttgtttctgcgtgcagatgttcaacgctgaacataatctatcgtaatcaacaaaaaccgagaaataaatagggcgggcttccccattgctgttgtttacttttgcatagaaacctatgtttttattagtgatttccacctaacgcccctatgaaaagagaagattgtccgcctttcggctttcgttatatgagtctgtcgaagtctgtcgacaaatgtggatgactttaccacaatctcaaagcctgaaatcaggaaaaaaggactgatccttaaagacggccagaagctcctctaaaccgtttcagccgctcttagataaaagacattcaagaacagaaaaagacgcccaaagagcgtctttttctactttttcgccatgtatttattcaaaaacgcatctgcctcagaaatttgtgtgccttggtaatagtactttacaatgtcatcaaccgttttgccttctttggccataaaattcgctccgtattggctcatcccaacaccgtggccaaatcctctcgtcgtgactgtaattgtgtctccatttcgcttccattcaaaatcggcggagttgagacccagcttttcacgtatgtctcttcctttcagcgtcttgccgttaatgacggcagttgcgacctggtggcccggtgtctcgccggtaatcttccctactgcgctagatccatccagcttgacgccaagcttttgctgaaattctgccgctgtaaaggttttcgttgccttatatttcggagactttttatcccatgggcttttgacgctttttaaatatgggatagcacttgtccaataagcttctgcattctctgtgtagccgttgcttgtggagaaaaaggatgcttcaatcggctggttgttgtacgttaagattttgccttgcgtactggctaccgcagctgtgattttcttcagttttgtctcatagcttgtgccccactgttttttcagctccgctttgtttttatacacctggaacatctgtgtatcatccaccagtgagcctttaggagcctcaaccgctgaatttgacaccatcagtctgacaataaatgttctggcggcgagggcctgggctttcagtgcttcagattcaaaggttgccggcatttcggaggcgacgactccaatcacatactcttcaagcggaatgttttctacggattgatttgcggttcgatagacgggaatagaaacaggtgatgctttcaatgtttctgctcctttcgatgctggtttcgtgctgactgctgtcttttctgattctacactggcccccgcttccttattatgctggaatggtataaccaagagtgtgggaaccaagagaatcaatgcacatagtacggatagtgtgattgcgaattgtttcatattcagctgcctcctgctcgggattcgactctagtctagtctatgggcagggacaagctaatatgactctcgttttggacagaaactttatttgtcatttacgtattcttttttgctattttgcgcataatgatgataatacacaaaaaataaaaaaccagtatgccagagtgacatactgattttcaagtaagtttatgcatttaagtcagaaacgacttctttattctcttgctcagaagcagactcatcatttacacgttcgatgtctgcgcccagagcggcaagcttctgatggaaatcaacgtaaccgcggtctaagtgcttcaattcagtaacacgtgtgtgaccttcagccactaaccccgcaagaatcagcgctgcacctgcacgcaaatcagtcgctgcaacttcagctccctgaagctgtacaggaccgttaatgatgacagaacgtccttcaatcttgatatcaccattcatacggcggaattcttccgcatgcataaaacggttttcaaaaacggtttctgtaatcatgcttgtgccgcttgcacgaagcagaagcgccatcatttgtgactgcatatcagtcgggaagcccgggtgaggcattgttttgatgtcaatcggtttaagctctttcgggccgatgacacgcagaccttcaccttcatccttaattgttacacccatctcttccatttttgcaattaaagaggtgaggtgttcaggaaccgctccttttactaatacgtttccttcagtgattgcagcagcaaccataaatgtgcccgcttcaatacggtctggaataatatggtgttttacgccgtgaagcttttcgactccttcaattttgatggtgccggtgccagctccgcggatttttccgcccatgccgttgatatagtttgctaaatcaacgatttcgggttcttttgccacgttttccagcgttgttgttccttcagctagagcggctgccataatcaggttctctgtagctcctacacttgggaagtccagataaatttttgcgccttgcagtcggccttttacttcagcttcaatgaagccattaccgactttgatttctgcgcccattgcttcaaaaccttttaaatgctgatcaatcggtctggaaccaattgcgcatccgcccggaagtgcaactcttgcatgacctgtacgcgcaagaagcggccccatgacaagcacagacgcacgcattttacgaacatattcaaaaggtgcttcagtttgcaaagcgtatgaagcatttacagtcacttcattattttcaaaatgcacatctgctcctaaatgacgcaacacttcgttaattgtatatacatcggagagcgtaggtacatcacaaattacgcttttttcttcacttgctaataaagatgcagcgataacaggtaaaacggcatttttagcgccttcaactttgactgtgccgtttaacttctgaccgccgcggacgatgattttttccaaggtattcccctccgcgtccctaaattctctatattaatattcagtcgtaacgattggtgtgccaaccgtaacggtatgttttccgcccattcctgcacttctaagtgcaatttgcaaattcattttatgtttcgaggtcataatgtactcttcccactcatctgtaaacgcagaaatagaaacgaaatttggctcaactacatgttctactgatcttgcttgaaattcatttaataactgatttgcttttttttgcaaaacaatattcatattatcatctaagtgaccatttagacaagtaaaaataactactttttcttggaatatcccaagtgtctcccgttcaaactgttcatatgtatcattccagctatccggtgtctctagactcatttgctcatataataaatacgaagttggattgtgttttttgagggttgtgacaagctgcagtctaaaagaagatcgattttttttgtcagtatatgtgccaattgcctttatcattttatcttcccgtgcaatcacccaatcatattgacgatactctgattttaaacgttgcactttttgataaaattctttttcggtcagtgacatgttttgttttgcatgcaatgtccacttatctattgacacatcttggcgttccatcccctctgccatttgtgctaacggcgttaattcactcgcatgaatggtatggaaaacagcaatgacgaagcttaacatgacggaaatgataatagcgcggcttacttgttttttcttcatgttcatctctcccccttatccccagttttaccggaggcaagaggcgccatacgtaaaaatcttcgtcaaaactcgagctattcgcttcattcaaaacctattaaaatagatagggaagctgctgtgaataattgagataatctaaaaagaaattggcaacggccgttccaatggcaattgtcagcaaaatcatcaggagtcttgcctgcacgactttgccttttttgattaacggatctatattgacggcttgcaacgcccaccaagtcactgctataaaaatcaggtgaacgacaatgccgattgcagcctgctgtcccaatacactcatctattacactcctttctctgcgttcataccctttcttattatataagaagcacagataaagatgatacattttatacagaacggaataatcacccaaatctagggctaatccccgcttaaagtgcgattcttttacatggtatactttattggaaaggagctggcaaatgtgaatcattctttttttcagcctgaaaagcaatatggtgaggacctgccaatttttgatcaggaatgggaagcaattgcattctattatgattatagacagtcacagattgaagaactgaatgaattgtgtcagttttttaacatttctcttacctatacgagagaaagccttgaagagcttgaaaacctctattttcaaagtatacaagaacttttgcttgctgattggaatcttcctattgaagaattcgagaaaatgatcagtgtttatcttatagattgtgtgattgcccgccatgaagatgctgaatgggttgtaaaaccttatccctataaagacggcgcttatacacttggctttagaagacatcgcaaatcgtggcatacaatgaatgcctgtgatggtttatacctgcgtccaaaagaggatcgcccgctgttatcgctgtttgattctcttgtgcgttcataaaaaaatccttctctttatgagaaggattttttcttatttccctgctacatccaatctgttcaaagcccgctgtaacgcaagctcagcccgacgaatgtcagtatcatctgattgagaattcaaacgctcctgcgcccgctggcgtgcagcttcagcgcgctctttatcgatgccttctgctgtctcggcagcctgggcaaggatggtgacctgatcaggacggacttcgacaaatccgccgctgacggcaaccatttcagtctgcccgtcttttttcagacggacagcgccgattttaagaggagccacggttggaatatggcctggcaaaataccgagatcgccgctttcggctctcacactcaccatttcgatatccgcatcgtatactgggccgtcgggagtaacgatattgactttaacggtcttcatgcttttaccctcctaggaccagattaaacttctacacccatttcttttgctttctcaacaacttcttcgatacggcctacaagacggaatgcatcttctggaagatggtcatatttaccggctaagatttctttgaagccttgtaccgtctcttttacaggcacgtaagatcctttttgtccagtgaactgttcagccacgtggaagttctgagaaaggaagaactggatacggcgtgcgcggtgaacgacaagtttgtcttcctcgcctaattcatccataccgagaatcgcaatgatatcctgaagctctttgtaacgctgaagcgttgactgtacttcacgcgcaactgcataatgctcttccccgacaatttcaggagcaagggcgcgtgatgtagatgccaacggatcaaccgcagggtaaatacccatttcagttaatttacgctcaaggtttgttgtcgcatccaagtgagcgaacgttgtcgccggcgccgggtcagtgtagtcatcggcaggcacgtagatcgcctggatagatgtaactgatccaacgttcgtagacgtgatacgctcttggagctgacccatctcagttgcaagcgtcggctgataaccaaccgctgaaggcatacggccaagaagggctgaaacctctgaacccgcttgtgtgaaacggaaaatgttatcgatgaagaacagtacgtcctgtccttgtacatcacggaagtgctcagccattgtaaggcctgtcaaagcaacacgcatacgtgcgcccggcggctcgttcatttgtccgaataccatggctgttttgttgattacgccagagtcactcatttcgtagaaaaggtcgttcccttcacgagtacgctctcctacgccggcgaatacagagataccgccgtgctcttgcgcgatgttgttgattaattcctggattaatacggttttacctacaccggcaccaccgaacaatccgattttaccgcccttaatgtaaggagcaagcaaatcaacaaccttaatacctgtttcaagaatttcaacttctgttgaaagctgatcgaatgaaggcgcctgtctgtgaatcggatcctttttcgcatccgcaggaaccggctcattcaaatcaatattttctccgagaacgttaaatacacgtccaagtgttacatcaccaaccggtactgagattggcgctcctgtatctacagcttccataccgcgctgaacaccatctgtagatgccattgcgattgtacggactgtatcatcacctaaatgaagagcgacctcaagcgttaaatcaatacctacttcgttttcacttgcagctggctgtgaaattttaatcgcattataaatttcaggcaagtgaccgtcttcaaaacgcacgtcgacgaccggtcctaatacctggctaacgcgtcctttcttcatcgctatccctcctgacaaaatctttctattctaaagcggctgctccgccgacaatttccgtaatttcttgtgtgatggctgcttggcgagcgcggttgtaagaaagcgaaagtgaatcgataagttccttcgcgttgtctgtcgcatttttcatcgccgtcattcttgcagcgtgctcacttgctttactgtcaagaagcgcaccgaagattaagctttctgcatattgaggaagcaaaacctccagaacctcctcttcagatggttcaaattcataagacgccgttctttttccgccgccgctgcccaaatcagataacggcagaagttttttctccgttacttcttgagtaatggcgctgacaaaatggttataaacaaggtgcaattcatcaaacgcaccgtctataaacatttgaatcgtttgacgggcaagatctttaatttctgtaaacgttacttcatccccaagtcctgttaactcggaaatgatcggaatctcccgtttcttaaagaaatcacggcccactcttccgatggcaatcaccgcatactcatccttagactgatgacgttcttgcatggcctgataagcactccgtaaaaccgaactgttaaaagcgccggcaagaccgcggtcagacgtaatgacaaggtatgccgtttttttcacttctctgctgagaagcatcgggtgcttcacgttgccggaaactcttccgacgtttgacacaacctcttggattttatccatatatggcacaaatgattttgcattgttttcagcacgattcagcttagccgcagataccatctgcatggcttttgtaatctgacttgtttttttcgttgacgtgatccttgacttaatatcgcgtaatgaggccaaagatttcaccaccttttctcttcatctgcgtaaaaagagagaaaaagagaacctttttctctcatcagcattcgagttagttgcttggtgcaaatgtgcgtttgaagccttcgattgcagcattgaagtcttcatcagcaggaaggtttcctgttttcgcaattccgtcaagcaggtctttatggttttggtcaaggtacatgtagtactcttcttcaaaacgtctgatatccgccacaggaatatcatcgagatatccttttgtcagcgcataaagaatggctacttgcttttcaaccggaagcggcttgttcagatcctgcttcagcacttcaactgtacgcgcaccgcggttcagttttgcctgagtcgcttggtcgaggtcagaaccgaattgagcgaatgcttccagctcacggtatgacgcaaggtcaagacgcaaagtacctgatacttttttcatcgctttgatttgcgctgagccgccgacacgggatacagacaatccggcattgatcgctggacgtacgcctgagaagaacaaatcagattgcaggaagatctgtccgtcggtgatggaaatgacgttcgtcggaatataagcagagatatctccggcttgtgtttctacgaacggcagagctgtaattgatcctgcgcctttcgcgtcgctaagctttgctgcacgctcaagcagacgggaatgaagatagaatacatccccagggaacgcttcacggcctggcggacggcgaagaagcaaggacagctcacggtaagcggccgcttgtttagaaagatcatcgtatacaacaagaacgtgcttgccgttgtacataaattcttctgccattgtaaccccagcatacggtgccaggtacagaagcggtgccggctgtgaggcagacgccgttacaacaattgtataatcaagcgcgccgtgtttacgcaatgtttctactacgccgcggactgttgattctttttggccgatcgcaacatatacgcagatcatgtcttggtctttttggttcaggatcgcatcgatcgcaacagatgttttacctgtttgacggtcaccgatgatcagctcacgctggccgcggccgattggaatcagtgcatcgatcgctttgataccggtttgaagcggttcatgaacggatttacggtccataacgcctggtgcagggctttcaatcggacgagttttgcttgtaaggatcgggccaagtccgtctaccggttggcctagcgggtttacaatacggccgattaactcttcaccaacaggaacctccatgatgcgacctgttctttttacttcgtctccctcacggatctcactgaaaggtcctaagatgacgatacctacgtttgattcttcaaggttttgagccatacccaaaacaccgtttgaaaattcgacaagttcaccggccatacagttgtcaaggccgtgcacacgtgcaataccgtcaccgacttggatgactgtacctacgtcttgaacttcaatatcagattgataattttgtatttgctgttttatcagcgtgctaatctcttcagctttgatgctcacttaggtttcaccccttctatcgattttccccggctaattgacgttcgatgcgctgaagcttcccgcttacgctgccgtcataaatccggtttccaatgcggactttaatgccgcctattaaatccgtctgcacttcatttctgattctcagtgaagcgactccggctttttttgcaaacacttgtgataatggtaacatttctgcatccgtcagcggtttcactgaatatacgattgcgtcttctgtttgacgggccacatttgcgagtttgataaactcatctgtgagctcagggacaatcgcggcacgatggcggtcaatcaaaagaaaaatcgtattgagtacggactgtgacaaagagccaaatgcattttgaatcagctcttttttcttcgcagccggcaccttcggatggttcaacacatcattaagcgctttttcattttgaaatacttgttttacaacaattagctcttcttctacttgattcagctgagcggactcattggctatatcaaaaagagctgatgcatatcgtttagagacagctgatccactcatcggctttctcctacctctttaagatagtcctggatcaatttctcttgcgcttgttcatccagttctttttcgatcactttcgacgcaatcatgacagaaagagacgctacttgctcacggagagcagaaaccgcctgttccttttccttcacgatttcagttcttgctgcttctttcagacgttcagattctgcacgtgcagcctgaataatctcttctttttgcttctctcccagtttctttgcgttttcgataagagtttgggattcctgtcttgcttcttttaaaagaacgcgctgctcttcaatcagctgctgcgcttctttatttttttcttcagcagacgtaatttctccagcgatgtggtcttcacgctgtttcattatgtttaatagcggccctaaagcgtatttcttcagaagcgctaataagattaacatagctaacagttggaacaggatatctccgccgttaaacgacaatcctagttcaagtggtaattgagacatctactacggcaactcccttctgcaggtttttctttgctgatccagcagccgcacttgtctcttttcagccggcaaggcgggatgcttatcagacataaagcaatggcgaaggttctcttggaatgatcttcgccatttttagttcatataaggcttttatgcttagccaaagaacgctaagaatgcgataacgacagcgataataggaagggcttcaactaatgcgatacccatgaacataagagttctcagttctttacctgcttccggctgacgggcaatcccctctaccgtacgtgaaacaatcaaaccgttaccaatacctgcaccaagtgcgcctaaaccaattgcaatcgcagctgctattaaattcatgaaaaagttcctcctttaaaatgttatccgtttggatataatgttttaatgatcatgactgattttatgagacatgtacaccatcgtcagcattgtaaagataaatgcctggatagcaccaataaataaactgaatgcttgccatgccagcatcggcagaatggcaccgattgtaccgacaagaccgagagccacgctttgcgaataatggcttgttgctaatcccgcaagcaggccgagaagaatctcaccggcgaagatgttaccatacagccgcaaacctagagtcagcgtattcgcaaactcttcgatgattttcatcgggagcatgaatggaacaggtcttaaatagtctttggaatattccttgagccctttcatcttcacaccatagtagtgggttaaagcaacaaccatcacggctagcgttaatgtaatggcaggatcggctgtcggagacttccaccagagctcatgtccgattgtaatagagaacggcagccccagcatattcgacacaaatatgtacatcagcaatgtgacaccaagtgccaagaagttagcccctgtttttaaatccattgtactgccaataatattgcggacgaaatcaacaatccattccataaagttctgggcttttccgggacggatcgaaagcgttcttgtcgtcaatatagcaatcaataaaacaatcacactcgccacagtaatcatcagaatgtttgtcagattaaaagtaagacctagaaattctatagttctgtaaccatgattcaaagggttttcacctctcttccattgatgaacgtttaagctggataaaggaatctatcataatgacagggtatattgtcattaatccaataactgtacttgccatatgaaagtattcgggatttttataggcaacagccacagcaagaatcgcattgcaccaccgcgctgcgctcccgagagatcgtatggactttcctttctcaacagctctgtcaaaagcattcattcttctgacgagcagtaaaaaattaaacaaactgaaaacagttcccagaataaggcctaaaaaaacggttttatacgctgttaaaccataacccagtacatacactgccaaaatgaacaataaatatttgcgttgtctgctaaatgtaagcttgggatcgtccatcaattatctgtctcctgatgaaaaaataatgtatagcttggatacggcaaaaatcagcggttaacccttagtagaagaccttttttgaccggcaaaacgggcctgttcgaaaaaatcattcatccgcaagccttgcagggatgctgtttcattcgcttaaataaatcctcataatacgggtttgctgagaggatttacattgaggatgaggactataatgaaagctatgaaaaccttctcataataccctcgtttagcatacaatagcccctaacatgtgtcaatctgtttaaagttaaaaaactttttatactttacgtctccacagaatgttcacattttcacctataattgtatacagattcaccgaatagcaaaaaactggataaaaaaatgaaacccccttttggggatttcattttttattttgttccaaacatgcgatcacccgcatctccgagacctggaacaatatatcctttttcatttaatttttcatctagcgccgcaatgtaaatatcaacgtccgaatgatgcttctgcaattcttccacaccctccggcgctgctacaagacacatgaaacggatatttttcgcaccgcgttttttaaggctgtgaatggcttcaactgcggaaccgcctgtagcgagcatcgggtcaaccacgatgaattcacgctcttccacatcagaaggaagcttgacatagtattccacgggttttaaggtttctggatcacggtaaaggccgacatgtcccacttttgccgcaggaatcagctttaaaatgccgtcaaccattcccaatcctgctctgaggataggaaccactccgagttttttccctgagatgactttcgatttcgcagcctgaaccggtgtattgatatccacttcttccagaggaagatcgcgggtaatttcaaatgccatgagtgtagccacttcatctactaactctctaaaatccttcgtacctgtattttcattccgtatatatgtcagcttgtgctgaattaaaggatgatcaaatacataaacctttcccatactgtgtttcagctccttttttattgtcccatcaacaattacacacttctattgattctacaaaaaaagacattgagtttcaagaacatcgtcaaaaaacccgccgggcataagccccagcgggttttaggatcttaataatctaattctttatataaaggaaatttatcagtcagagcagctacacgctgtcttgcttcttcaagttttccttcgtcttcgtggtttttcaatgcaagcgcaatgatagcaccgacttcttctaatgcgtctccgtcaaaaccacggctggttacagcagctgtcccaagacggatgccgcttgttacgaaaggtttttcaggatcatatggaatcgcgtttttgttagacgtaataccgatttcatcaagtacatgctccgcaaccttaccagtcagtccgagcgaacgaagatcaacaaggataaggtggttgtctgttccgcctgaaacgagctggatgccctctttcgttaaggcttcagccagacgtttcgcgtttgaaatgacgttttgtgcatatgttttgaaatcgtcctgcaatacttcaccgaatgaaacagcttttgcggcaataacgtgcatcagagggccgccttgaattccagggaagatcgatttatcaattttcttgccaaactcttcacggcaaaggatcataccgcctcgaggaccgcgaagtgttttatgtgttgttgttgtaacgaaatcagcgtaaggaaccgggtttggatgaaggcctgccgcaacaagtcctgcgatatgtgccatatccaccatgaagtaagcgccgacttcatcagcaatttcacggaatttcttaaagtcgattgtacgaggatacgcacttgctcctgctacgataagcttcggtttatgagcgagggctttttcacgcacgtcatcgtaatcaatatattgagtttctttatctacgccgtactcaacaaagttatattgaacaccgctgaagttgactgggcttccgtgtgttaaatggccgccgtgggagaggttcatcccaagtacagtatcgccttgctccaaaatcgtgaagtacactgccatgtttgcttgtgcgcctgaatgaggctgaacgtttacatgctccgctccaaagatttccttcgcgcggtcacgggcgatatcttcaacgacatcgacgtgctcgcatccgccgtagtagcgtttgcccggatatccttctgcgtacttatttgtcaaaacagatccttgtgcttccataactgcttcacttacaaagttctcagaagcaatcaattcgatcttagtctgttggcgttcacgctcatttttaatggcgttaaacacttgttcgtcttgcgcaggtaaatgtttcatcagcgagatcctctcctatccgtatcctgttctttgtttttaccatcactattgtacatggtttttaaggccgatgtaaaagattatttttaaaaaatctaaatttttattggtaaaaacgaatattaataacttaaatttaatttaaagttcggaatttatttcactgtcttaaaataaaagaaaagactggctatgcagtcctttcattcacactcataaaccgcccgcactccgccgattagtttcggccgtgtacgcgccaatgtcacatgagctgaaccgaggctgttttgagagacacgcatagggacagccaccggcttcagatgcatgccgataaacgtatcgcctatatcaattccggcgtcagcctgaatggtttcaacaagaacaggagacttcatctgcttaaacgcataagacgccatcgctccgcccgcttttggaacgggcacggcagaaacggttggaagcctgaacagcttggctgtttctgcttcgacgacaagcgctctgtttaaatgctcgcagcattgaaacgccagatggattcccgttttttcccggagctcagcaagtccgctgtagatgctttcagcgatatctacactgcccgatgtgccgatccggctgccggccacttcgctcgtgctgcatccaaggacgaagagctgatcttgtttcaattccgcttggtcctgaaactcagacagcatcgtcttccacgtttgtttcaactcattcattaaacagcacccctacaggtttttctcttcataatcggagatttttccaatacgcgtttggtgtcttcccccggtaaactcagtagtcagccagatttttgcgatttcccgagccaaaccaggtccgatcacccgttcacccatcgcaaggatgtttgtgtcattatgctccctcgtcgccttcgcgctgaaggtatcgtgcgccagcgcgcagcgaatcccttttactttattagcggaaatgctcatgccgatgcctgtcccgcaaattaaaatgcctctgtcaacttcgccgctaaccactttttcggccaccggaaaagcataatccggataatcgacagagccgctgccgcagtcacagcccatatcaatatattcaatttgcaattcgtccattaactctttgatttcatttcgaatgtgaacgccgccatgatccgatgcaatggctactttcatctgcttttcctcccagcgtgtgtgatgcggcccgcccgctttattgaccgcgcagcctgtccgctctttgattcacaccatatgatgtgcttttcactatattctactccttcacgcaggatttgcaaatgacctgtttgcagattttctgacaacttatctacggtcttttttcagctgttttgccagctgccgaagaagctcttcaagctcatctcgcgtttgtttatagatgtcaattgagccgccgaacggatcgaggacatcaccatggctgcctgtgacatattcttttaacgtaaacactttatcacgataacgtccaaattggctggcaatgatctgtttgtgctgatgggtcatagccagaaccaaatcagccgattccataagttcttcagttaatggagaagacacatgattaagggcaatgtgtttttcaaacaacgcttcgactgcatgaggcgtcgctttcccattaggtgaagcaaacacacctgccgagcggacattgacattcagcccttccatttctgcaattgatttaaaaagcgcctcagccattgggctgcggcacgtatttccagtacagacaaaaataatatccatgtcagtcaccccttatttttctctattatatatgaagaaaaaagaaacggcgacttcgtttcttttattggtatattaaattggcaaaagcagctttaatccaaacacgattaatatgatgcccccgagcgcttcgctgtatgtgccaagccatgactgcacttgttttccgaccagcaggcccagccatgtcaacatcatgctgaacagcccgaacagggtaattgtgaggagcggatgcgagccgtatatccccaagctcaagccgacggaaaagctgtcaaggctgacgccgatggcaaacagcaataagcccggccctgccggtgacatgaatcgttcttctgactgtttaaaagaggccataagcatttgaaccccaagaacaaaaagcagcgccccaccgatataaaccgctaacacgccgaggagccctgacagcatgttaccggccgccatccctgcgagaggcatgatgacgtgaaagaggccgatgatgaaaccaatatagaatatctgcttctttctaagtttgaccatgcccattccaaggccgacagaaaaagcatccatccctaaagcaaacgccatgatgcttaatgtaatcagttcgcctataaacaaatccgacatacataaataacccccttggacacgccccgcttttttagcctatgcgtgtccaaaaagggttagaacatctgactgctttcagcgaatcactcttcctccggcggctttcatcagcctgttcataatagcaagaccgacacctgtatccggaaaggattccgctataatgaaatccaccttattctcatcaaagctgcgcaaagcatcatacagccctgccgcaacagtctcaagctgagcccgtcttccgcagctcttcacataatcagcggaataaacgcccgcgttttcttctgtcgtcaggacaccgacccgtcttccgccctgttgatattcttgaatgaggtgctgaatgcgctctgggctgccttcgcaaatggcaagaggcgctgtcggcgcataatgtgtatatttcatccctggagaaatcggcttctcgttttgatcgctgagccctttatccacatggatcggcccgatcacggcctcaatttgttccttcgtaatgccgcccggacgcaggagaacagggatgtcgtccgcacatgaaagcacagttgattcgaccccgattccggtagggcctccatccataataccggctatgcggccatccaagtcgtgagccacatgctccgcttttgtgggacttggcttgcctgatagattggcgctcggtgctgcaatcggcagtcccgattcgcgaatcaatgcaagggcaagcggatgatccggcattctaatggcaaccgtttcaagacctgccgttacacgaggtgaaagcgcatcaggtttgcaaggcagaatgagcgtaagtgctcccggccaaaaccgtttcatcaatgttttcgccttttccggcgccgggcccgttaaatcctcaagctggctgatatccgcaatgtggacaatcaggggattatcgctcggccgccctttcgcctcatatatttttttgacagcatccgtattttttgcgtttgcgcctaggccatatactgtttctgtcggaaaggcaacgacctcattttctcggagcaaagcggctgcttgtgcaatttgtggatcatttgtggataactcgtcagttacatccacaaaccatcttttcgttttcatttctgaccaaactccttattcacaacaataaaacgattgttttacgcgtgtaatccttttgaaagtataaaagatgtcctgtaataaaacaagcgttatccacaaattgtggacaacgctaataaagaagtggataagtatgtgtataaactgcacttatccagacgcttttttcatcaaaacggccccttctgtttgccgcgattcacagaagtgatcagaagaaaacagctcctccggtacactttcagctctttcaaaacccatggccgtcagaaagtccgcagaggaatgctgattcgctactaggtacacggttttgatctgatgcttttcgcacagcacctccatgctttgaaaaagcgtgacgatgtggccttggtgaagcttgtccgatatgacaagtgatcgcagcagcccctggtcacagctgattttttcaataccgaggcatccggcaatgtttttctcactgtcctccagcataagaaattgagtgaagccttctttcacgccttcatagctggttttcgcctgttttaaaaattcctcgagcacatctccgtctttttcccttgccacccgcagttgataaaacatccgttcaccccgtttttgcgttctttcttccaatctatgaggcaaatctatttttagaccagatgattaggaaaaaaggtcggaaatccattcgactaaaaagaatttcacttctgtgccgtcttctttttcttcattctcttcttttttggctttttccgctttagcggttacgtcctcaagcactttttcagtctgcttttttgaggcttctttatcttcttgttctttgacggcttccccgttagaaaaatcgagaaagcagaggggcgggaacagcacacaccaccagttggcgccgtctccgtttccaagcgtaatcaaaatcgcttcatactcaccggcaggatataccatgttgccgtaaagctttgtcggaaacgagattttgtcaaaatcaacggatatcgactgattcgctccttctttctccattgtttcctttgcaattgctttgatttcaggcagctttgaacgaatcacgcgacgcgcttcttcaatagaagtaatatcctttacccaagttgtgatttctttattcaccgcgtctcttatatgacgttttaattgctggtcttgatcactatcgctgtttgccaatattctcaaacgaatcgcctgatccggtatgaccaccggctgattttccgatttctgtgccgtctcttcttttgccagccctacgagcgctccagataataaaagaaagatatatatacaaatgattactgtttttttcatcggtccccaccgttcctctccgtgctttgtttctagccctattatggacaaggagagccgggggtaaacgtgcagggtgaaaaaaatctagcaagctgttaatcttatttatggtacgatagtgttttaggaggtttaagatgaaatacaattatacagtgctgttatcagcattcacgatgtccgttctttattcagtaatttatattcattcatttatcattgccgctctcatcacaatggcattttattttctgtttccttatttgatcttcgcactgccgcttcaaatcatgatgaataaaaagccgaaacggttcagccctttgtatctgctgtattaccttatcgctgcttttattgccaacgcgatcattttcggcgtgcttcagccttcgggacaatctttgtttcaaaatacagccttttatcttttcgctgtattaacagctcttatctattggatatgggattctgttttactgcaaaaaaaggaagcctaagaggcttccttttttattaaaacaaaatcgtcagcaaataacatagaatggaaggtatcgccgcaacaaagaaagcggccgccattttcatgcgagatgtacggccttctttggtttcagaatggtagtttgcccgctgatcgcttccgcttacagccaaacccgatgtaatgatcgcgagccccactaaaacgagagacgcaacgccaaaaatcgcttcatatgaaagagcctgcggaaaaatggtgccaatcatgctctcaatcgcaatgagcaggattcctgctgtcagggcctttttcatgtttacatcccctttgctggtgttaaacagcttgatccattcactcgccagcaagctgcttatttatttttatgaatcagagcgcatatggttctgtcttttccattaatatctttcagcacttccacttccgcccccttaaacgccttgaggatcaggtctttgaccgccgctccctgtttccagccgatttcaaaaacgacaaatactttatccttcataacaagcggaatgtcttccataaaccgcttataaaatttcagcccgtctccgccatcggtgagtgcgtgcagcggctcatgaaaacggacaatttccgataaatcagccatttcttcctctgaaatatatggcgggtttgagacaatgatatccgctttttttcccgccttaataaaaggctcaagcagatcgccctgataaaagcgcacattcgctccgagtttttctgcattggcagaggcgacttgcagcgcctctttcgaaatatcgaccgccgacacagaaaagctttggttttcaagcgcaagcgtgacggctattgcgccgctccctgtaccaacgtcaacaacttcaagcttgccgtcttcagaaaagacactccgatatttttcaagcaaatgaaagacaacttcttcagtttccggccgcgggatcagcacatcatcattcaccataaattcccgtccataaaaaaactcttttcctataatgtattgaaccggcacgccctctttatgcatctcaacgtgacgcttaaagcgatacagttcgtcttcaccaatcggttcctgtaagcttgcgagcagtttgcttctctccattccggtatcataaagcaataggagctcggcagcattttcttctcttcccgcttcggttaaataagaagaagcccatttcagggcttcgaatatcgtcttcatcttaaccttccgactgctgaagcttgcttgcctgatcttcaacaatcagcgcttcaaccacttcgtcaagttttccttcaagaatctgatcaagcttttgaatcgtcaaaccgattctgtgatccgtcacacggttttgcgggaagttgtatgtgcggatacgttcagagcggtcaccagatccgactgctgatttccgtgtttgatcatattcagcctgggcttcctgctgaaatttatcatagattctggcacggagaaccttcattgctttttctttgttcttaatttgagatttttcatcctggcatgatacaactacacctgtcggcaagtgagtcagacgaaccgcagacattgttgtgttaacgctttgtccgcccggtccgcttgaagcaaacgtatcgacacggatatccttctcatggatgtcaacctctacctcttctgcctcaggaagacatgctactgttgcagtggatgtatggatgcgtccgcctgattctgtttccggaacacgctgtacgcggtgggcgccgttttcatatttgagtttagaatacgcgccgcttcccgtaatcataaagatgatctctttgtagccgcccgttccggttacattcgcttccatgacctctgttttccagccctgaagctcagcataacgggaatacattctgtacaggttgcccgcgaataaagcggcttcctcgcctcccgcagccccgcggatctccataataacgtttttgtcgtcattaggatctttcgggatcaggagcaccttcaggcgttctgacagtgtttccgtttccttctgaagttcagaaatctcttccttcaccatgtcgcgcatctcagcatccagcttctcttcaagcatcgcttttgcatcagccagctgttctgacgcatctctgtattgtctatatacgtcaactgtttcttgtatatcagattgctcttttgaatattctcttagctttttcggatcgttgactacttctggatcgctcaaaagctcatttaatttctcgtatcgttcttcaattgattttaaacggtctaacacggtcttcacctctgttttcctgtgcgtaacattctcattatagtatagtgattaaccccagtcaaaagcatttcaatcccagctttaaaagcctcctctgctatactgggaatcgaggagggatattgttgctgaaatccatacatcatattgcaatcatatgttcagattacgaaaagtcgaaagctttctacgtacataagcttggttttcaggtgattcaagaaacgtaccgcgaagagcgcagctcctataagcttgatttgtcgcttaacggctcgtatgtcattgagctgttctcgtttcccgatccgcccgaacgacaaacccggcctgaagccgcaggcctgcgccacctcgcctttacagtcggtagcttggataaagcggttcaggagcttcatgaaaaaggaatcgaaacagagccaatcagaacagacccgctgaccggcaaacgtttcaccttcttttttgatcctgaccagcttccattagaactgtatgaacaataacagtttttgaagaaaaaaaggagatacccactttctttgccgaatcttttcttgttttgtctaacgggaagggaacctcattctatggtcgaatacctagcttaaaaggaggtatgggatcatgaatacaaatatggtagcaagtgaactcggcgtctccgcaaaaacggtgcagcggtgggtgaagcagctgaatctaccggccgaacgcaatgagctcggacactattcgttcacggcagaagacgtgaaggttctaaaatccgttcaaaaacaaatctctgaaggcacggcgattcaggatattcatctgccgaaaagcgctaaaaagcgcacaggcttccttgtccaaaaaacaaatagcgacacagaacgaagaatcgagcagcttgaacaaaagctggacacccttttacagcaaaggcaggacgaaagtgaattgatggcaagaatgtcggaactggaacgccagctgaaacaaaaagccgatgaaggtgtatcttaccagctgcttcagcaccgcagagaaatcgatgatattcttgcagatctgcaatcactgacctcacaaatgaaagaattcaccgctcagccgatccccgagactgctgctgcttctgaaaaaaccaaaacaagaaaaaaaccgctgctgtcactgttcaaatttcaaacctaaagcaaaaagctccccgtaaagggagctttttttgttacgcagtaagcgcgataatgattggaagtgaaatcaatgacagaatcgcactgaccacaaacgcagttgcagtttcttcttcttgtttctcgaaacgagtcgcaatcatggctgcaacggcagaaccagggaatgcaacaagaaggattgcttttgttgtttggtcagccggaagtccgatagcaagagcaatcaggaacattaatgcaggctgaaccgcaacttttagtaacgcaataccgatagccggcatactgagtttaattttacgaataccaacggtaacaccgacagcaaagagagcaacaccagatgttgtgcttccaagctgatcaagcattttaacacccagctcaggaagagtgaaattgaaaaccagcaccaagatcatactgattaacggagcagctgcaagcggctcacaaagaccatgcaggattgattttcctgtcatcttccagaagctgtcgccactctcttcgtttttcttagaagactcaccaacagtagcgataatgatcgcgagcggatcaagaatcgcgttaaccacgatacctgtgaccgcgatcggaatcgcaacttcattcgctccgaataagcttcccaataccgggatacccataaatgcgaatgtcggctgtgcagagttcaaagaaaatacagatgagttcgttaaatcatacttgaaaataaatctgcaaaccaaaagaatgatgatatagaaaccaacaatcccaataattaaagaaatcattaaaggtacttgtgataaaaattcacttctggaagttgtcaaaataccagcgataaagtgagctggaagtgcgtatttcgttactaacgtacttaccccttttgccgacttggcatcataacttccaaaatgtcctgcaaaccaccccagcacgataacaaagaagatcggcgccaggaggattaagatatctaagatgctcaaaatattctcctccaaatcctatgtccgtatactttagctttacaaaaagctttccctcggacagaaaaatttactcgctaattatttcgcgatgacttttttgtattcaggtgtccacattgcttcaagtaccgcttgtttcacatcttcaggctgacgatttgccacgccgtctttaattgctgcttcagcaacggcaatcgcaacttggatagaaacctcttgaagcttatcaatgcttggaagcaatcctgctccaggtgtttcaagatcaaccatttcagcaatcgcatcagcagttgctgcaaacatagcaggtgtaatgatacgcgcttcagctacaattgaaccaagtccaagaccagggaacgcgaatgcgttgttagattgtccgatttcataagaaacaccgttgtattctacattgtcaaatgggcttcctgttgcaataagcacttttccgtcagtccatttgaacagatcttcaggaacagcttcagcaaggtgagtcgggttagacatcggcatgataaccggacggtctacgtgagatgccatttcttttacaatttcctctgtgaatgcacctgaaacccctgaagtaccaatcaagattgttggtttcgcttgacgaacgacttcatcgaatggaatttgacctttttcatcgcgcttccagtctttcacttcatccgcattgcgaaggtaaggtttttggaaatcaaggatgccttcgatgtcttcagtcagcaagcctctgtaatcaagtgtgtagaaacgtttgttagcttcttcttcagataatccggctagcaccattgtgtcacggatttggtcagcaataccgataccagcagaaccagcaccgaagataacaacacgctgatctttaatagaagcgccggttttcttcatagcggcaagcacacctgcaagtgtaatcgcgccagtaccttgaatatcatcattaaatgtcaggatttcatgattgtattttttcatgatgttgcgtgcatttttgttgccaaggtcttcccagtgaagaagcgctttagggaagaatttcaatgcagcttttacataagcgtcaatgaaagcttcgtagcgttcaccttgaacacgttcatgcttgttaccaatatataaaggatcgtttagaagtttttcgttgttcgtaccgacatcaagcacaaccgggataacacggctagggtcaataccagctgcagcagtgtaaacagctaatttaccgattgcgatattaataccgcctacaccccagtcaccgataccgagaatgctttcagagtcagtagcaacgataagatcaatatcgcctgctgtcgcgtgaaggttttcaaacgctttttcaataccgtcaatgttgtcgattgacaagtagattccttgaggtcttctatattcatggctgtactcctgaatcgcttcaccaactgttggtgtgtacacaacaggaagcatttcgcgaagatggtttttcagcaatttatagaaaagaacttcgttacggtttgcaagatcacttaagtaaacattttgacgaaggcggtcaggctgcgcttggaattgctcgtacgcgcgttgtgcttgttgatcaagagaaagtacagttggcggcagaagcccttctaagccgagttcttgtctttcttctagtgaaaaagcaacgcctttatttaaagtaggaatagataaaacttcttttcctctaagagttgtttctaagtggccttctttcgttttttttatgttattcaagcaaatctccttctttcttgaaatagttaaccaagttaagtaataacccatctaaaatatgaccgatcatgatctttatgcgactttgtgacaattattcgaacaatgtctcaaaactatttacattacgtaagctattgtatgcctgtcaaaatcaaaattcaagggaagaaaattacttaattttttaatatacttatttaaattttttaattgcatattatcagaatataaaaaaaacaccggtgtttttagccggtgcattctatctttatacccatgttttggactattttttagatttacctgggacttcgtgatgatgtctgcatcttgcttcatatgattcagatgcaccaaccaaaatgaccggatcatcgtaagaagcaggtttgccgtcaatgaggcgctgtgttctgctcgccggtgatccgcaaacagaacagacggcttgcagctttgtcacactttccgcaatcgccatgatattcgggacgacaccgaacggctctcccctaaaatccatatcaaggcctgctgctatcacacggtagcctttatcggcaagagatgataaaacctcaacaatttcctgatcaaaaaactgcacttcatcaaccgcaatcacatctgtactttcactgatgtgatcccaaatgtccgcagcagacgaaatggcatagctcgtcatcgatgttccattatgggagacaacagcagcttcgctgtatcggttatcaattacaggcttaaataccctgacttcctgcttggcataagttgctctcttcactcttctgatcagctcttcagatttccccgagaacatgctgccgcaaatcagctcaagccacccgctttgtttcattatgtacataggcttcgctcccctctctctgccagctgtgttttagacaatataaaaaacaggcaagactgctgcttgcctgttgagaaatctattattacttaagaccgtattttttgttaaagcgatcaacacgaccatcagcagaagcgaatttttgacggccagtgtagaatgggtggcattcagagcaaatctcaacgcgtacctcttcttttactgagcctgtttcaaattcatttccgcaagcgcatttaactgttgcttttttgaaattaggatgaattcctgctttcattgtatccatctccttccgccctgaatcccgtgtggaaacagagttattatttcggagcattgtccgaaacgcatatgagaaaattatatcagtgatttacttcttttgcaaatacaatttaccttcttgcagatgatagatttgcctgtttccattcttgattgagaatatcgaaaaattcctggtttgttttggtttttttcatttttctcatgaacttttctgcgaaatcaggtgaatcagacatcgttttgcggatagaccataaacgatcaagatgctctttaggcacaagcagctcttctttgcgcgttcctgaacggcggatatcgatagcagggaagatgcggcgctcggcaagagagcggtcaaggtgaagctccatgttgcctgttcccttgaattcttcataaatgacatcatccatacgtgaacctgtatcgaccagagccgtagcaaggatggttaagctgccgccctcttcgatatttctcgcagccccaaagaagcgtttcggacggtggaacgccgctgggtcaatccccccggaaagcgttcttccacttggcggaatcactaagttgtaggcgcgggcaagacgtgtgatgctgtccatcaggataatgacgtcttttttgtgttccacgagacgcatcgcacgttcaagcacaagctcggccactttgatatggttttccggcacttcatcaaacgttgagctgacgacatccccagctacagagcgctcgatatcggttacttcctcaggtctttcgtcaattaaaagcacgatcagctctgcttcaggctggttcgctgtaatgctgttggcaatttccttcagcaacatcgtttttccggctttcggcggcgcaacaatcaatccgcgctgcccaaatccaaccggcgccatcatgtccataattcttgtagacaagaagttcggctttgtttcaagcaccatttgacgatccggataaagtggcgtaagagccgggaaatgcacacgctcttttgcagattcgggatcatccccatttactgcttcaacgtgcaaaagtccatagtaacgctcattttcttttggcgggcgaaccttgccagatactttgtctccgttccgcaaatcgaaacggcggatttgtgaagctgagatgtaaatgtcttctgagcttggagagtagttgatcggtctcaggaatccgaaaccttcagactggatgatctcgagaacgccttccataaacagcagatcttcctgttctgcattcgctttcagaatggcgaaaatgagttctttttttgtcagtttgctgtaataggagattttataatgtcttgcaagttcataaagctctttcaatttcatattttccaaagaggaaatagatacgtctttcataaaaacaccacgcttttcatagtcaatatcttactctgaacatgtcatctgctgcttttgcacaacatccgccaaagcacattctttttttaacataaaggaacttctatcggtaacacttccacccatgatcggcgcttttgttaaaaggattgtcttaatgagttttgaaggaagcgaggacaaaaacatgagaagatcaatacttatatcgtctgtatgcggtagaaattgaaactttcctagtgcttaaaagaaggtattacgcagtaaaattcgcagcactctttatttttaccttatttcaaaaaattattcaactgaaataaggttttgacacggaattgatagagttgacgcttttctgcaaaagttaaagcgggctcacacccgctttttctgtttgttatggacggattacaagatttggtttctttttcaagctgtgtctgccgtcaacgaaacgaacagtgcccgattttgcacggataactaagctttcagttgtaccgacagagcctttgaattgaactccttttaacagctcgccgtcagtaacccctgtagctgcaaaaatcgcgtcatcacccttcacaaggtcttccatgcgaaggactttgcttaaatcaaggcccattttgtgacagcgagtgatttcttcttcgctttgcggaagaagtttaccaatgatttctccgccgagtgctttcagcgcaacagctgaaagcacaccctcaggagcgccgcctgatccgaacaggatatcaacgcccgtgtggtcgaaagccgtgttgatggcgcctgcgacatcgccgtcattgatcaatttgattctggcgccggcctcacgaagctcggaaatgattttttcgtgtctttcacggtttaaaattgtggcaacgacgtcctcaacgtccttgtttttcgcttttgccaccgctttaaggttgtcaatgacaggtgcttcgatgtcaatgcagcccaccgcttccggaccgactgcgattttttgcatatacatgtcaggagcattcagcagagtgccgtggtctgcgaccgcgatcaccgtcagcgcgttccagccgccgcttgctaagatgtttgtgccttcaagagggtcaactgcgacatccacgcgagggccgtacccgtttccgagtttttccccgatatacagcatcggcgcttcgtccatttccccttcaccgattacaacggtccctttcatcggcactgtatcaaaaacgtctctcattgcacttgttgccgcttcatcagcctcatcttttttcccccggcccatccatcttgctgatgccaatgccgcagcttcggtcacacgtaccaattccattgataaacttctttccatttcaacacgatctcctctcacaagaaaccattatgaattttgaagctgttctatttcttcgtcagtcattctttcccgccaaattgtcgctccaagcccctcaagcttcttctcaaggctgctgtatccgcggtcaatatgctccagtcccgtaatttccgtgacgccatcagccatcagtccggctaccaccaagcaggctccggcacgcagatcactcgccttcacttttgcgccttgaagctcaacaggacctgtgatgatggcagatctgccttctactttcatattggcacccattcgtctcagctcatcaatgtgcttgaatcttgccgagtagatggtgtctgtgacgacactcgtccctttcgcccttgtcaggagcgccgtcatcggctgctgtaaatcagtcggaaaccccgggtatacgagggttttgacgtcaaccggctttaagttcttctgcccgccgacaatgaggagctggtcgtcgcttgtttcgatatgatagcccatttctctcaactttgccgttaacgactctagatgagtgggaatgacgttatcgataatgacttccttgcccattgcagcccctgcaatcataaatgtcccggcttcaattctgtccggaatgatcgtatgcttgcagccgtgcagttccttcacgccgtcgattcgaatcacattggtgcccgcacctttgattttggcgcccatgctggtaagcaatgtcgcgacgtcaatgatctcaggctccttggcagcgttttcgatgatcgttttcccttctgccaaaacagcggcgagcataatgttaatcgttgccccaacgcttacgacatctaaataaatccgtgcgcctctcagcctttcagctcgcaaataaatggcgccttgttcattggttacttcagctccgagtgcttcaaagcctttgatatgctgatcaatcggacggggccctaagtgacagccgccaggcaatccaatgaccgcctgcttgaagcggccgagcatcgcccccattaaataatatgacgcgcgaagcttttttactttcccgttaggaagcggcatgctgatcatcgacgtagggtcaacaaccatttccccattctcaaaatgcacgtggccgccgatttcctttaacaggtcacgcagcgtttcaatatctgaaatctctggaagcccttcaattgtcacctcggaatttgccaaaatggttgcaggtattaacgcaacagcgctgtttttagcgccgctgatatgtactgtaccgtttaacgagtcaccgccggcaatattcaacttttccatgatagtctccttccataagaagatagctgcggagctaaataaaatgtcattttattctgtctctgcaaataaagctcatgtccaaaatctagccaattcgaagagaaagaatacaacacattgtaaaatatcaggaagaaaatagcgaagctttggggggtacaggtttcaaaagatgcacagagacccgccggctcgagagacatcgtcgtcatccggcaaaagcagtacgcatacccttcattccgatatcagcttctgcagcccaatgattccttctctgtaaagcggcgtcagcatctgaagatccgctgtatcaggtcggtgaaatacaaaggccgcggcaaacaggcataaagctgtttgccgcccctttcattatttgttccagtctgccaggaattgttcgattcctttgtctgttaacgggtgtttagtgagcgcatgaatgactttcagcggcattgtgccgatatgagcccctctaagagcagcttctgtcacgtgctgcggatggcggattgacgctgcaatgatttgcgtgtcaaggccgtgaatgtcaaaaatctgtttaacttctgaaatcaggtcaagcccgttgtggccgatgtcatctaaacgtcccaggaatggagatacatatgttgcccccgctctggcagcaagaagcgcctggttggcattgaagatcaatgtaacgtttgttttgatgcctaagtcagtaagtgctcttaccgcttttaaaccgtcagacgtcatcgggattttcaccgtaatgttcggagcgatcttcgccagttcttttccttcctcgatcatttcctcagctttcaaagaaataacctctgcgcttacagaccctttcacgacgtctgtgatctcgcgaagacggtcgtggaatgatacgttagcttcctttgctactaaactaggattcgtcgttacaccggcgagaattcctaattcattcgcttctctaatttcatcgatattggctgtatcaacaaagaataacattttcaaaaagcctccctgattaagaaattttctgaactgtgaatatgattgcgctttctaaagatagacggaaaaccgcctgtcaagctgtcaggcggctataaaaagttccaattgaattaagcttggtttgaagaaccaaattcacgcattttaccgataactgtttctttgatcgcttcacgagctggtccaaggtatttacgtggatcgtactcgtcaggcttagctgccaatgtttcgcgaacagcttttgcagaagaaatttggttttcagtattcacgttgattttagctgtaccaagtgaaattgattttttgatgtcagcagtcggaattccagtaccgccgtgaagaactagcggaagaccagttgattttccgatctcttccatttctttgaagccaaggtttggctcacctttgtaagggccgtgaacagaacctaatgcaggtgcaaggcagtcgatgccagtgcgctcaacaagctcttggcactctttaggatcagcgtagattacgccttcagcgataacgtcatcttcttgtccgcctactgttccaagctcagcttctacagatactccgtggaaatgagcaagctcaacaactttagcagttgttgctacgttttcttcaaatggatggtgagaagcgtcgatcattacagatgtgaaacctgcatgaatcgctttcgcacaagattcaaagcttgaaccatggtctaagtgaatcgcaacaggaactgtcactttgtactcttccataagtgcttttaccatagcaacgactgttttgaagccgcccatgtagcgtcccgcaccttcggaaacaccaaggatcactggagatttttcttcttcagctgcttgtaaaatcgcttgagtaaactcaaggttgtttaagttaaattgtcctacagcgtaccctttttctttagctgtattcaacatttccgtcatagaaactaaaggcatgtcgaatgtcctccttatgtagcctgattgtcttctagcgaaaaaagctttccaccctagcatgacccatatattgctgtcatatgtaaatactcagatcgctttttctccataactaggataccaacttttcgacaaatcggcaacataatgacatgattcatttgtttcttctttttgtcagttagacttcaggggcagatattttttgacggcgtctctgatttcgtcgatgtcaaacggcttggcgaagtgcgtcagagcgcccaattccttcgattcctggatcatgtcgagctctccgtatgccgtcatgataatgacccggatgttttcgtcaatgaccttcatccgttttaagatttcgattccgtccatgccgggaattttcatgtccaaaagcacaaggtcgggccgttcttttgtcacaatgtcaagcgcctgcaggccgttcgcagcctgaaacgtctggtagccttctttattgaacacttcatttagcaaaatacgaatgccgtattgatcatcaacgattaaaattttttcattcatcattttacaccccaatattatgattttcgtcaaaagtaagcagtattgtatgtattctgtttgattttcctatttcctttaattataatagtctactttacgacattttctgagcattttctcttttgttgtatactgatattgtacgttataaaggaggattcacttatgttgaaaatattcacgacgcagttaacaggtattttttcccgcattcaggataaggaatctgacgcgattgaagatggggcgcggctgcttgctcaagcggtgatcagcgggcattccatttatttatacggagcaaatgagctgcagggcgtcttttttgaggccactgaaagcaaagaacccttcccatctgtcaaagcctttccagaaagcgctgaggaagtgacagaaagcgacagggtgctgatgttttgctcagggacgggcacagccgaagaacaggcgctctcaaaagagctttatgaaaaaggtgcgggagtcgtatgcgtatcgcccgcagccaaagacagtgcgggaatagaacagtattgtgatgtgcatattgattctaaactaaaaatgccgcttgttccggatgaagacggcacccgttacgggtttccctctttaatgacagcactgtatgtctatcacgctttatcgtttacactaaaagaaattctgcaagagtatgcataatatcttattgtacatgctggaacttgccggaaacaaataaaaaagacttgcccgcttttgacaaacggcaagtcttttttattacttctgatttgcagcttcgacagacgctccgataaagcctttgaatagaggctgaggtcttgtcggtcttgacttgaactctgggtggaactgagaagccacgaaccaagggtggtctttcagctcgatgatttcaacaaggcgtccatcagggcttgtgcctgagaatacaaagccttgctcttccatttgctgtctgaattcattgttaaactcatagcggtggcggtggcgctcgtacaccacttcatcctgatacacttcaaaggctttcgtgccttcttcaagcttacaagggtaaaggccgagacgaagcgttcccccgagatcctccacatccttttgttcaggaagaagatcaatgatcgggtattgagttgacggatcaatttccgctgagtgggcgccttttaagcccaatacgtttcgtgcgtattcaatagacgccacctgcatgcccaagcaaatgcccaagaacggaatgttgttttcgcgcgcgtattttgtcgcgacgattttaccttcaacaccgcggtctccgaatccgcccggcacaatgatgccgtctgttccgcttgtgagttctgcgatattgttttctgtcacttcttccgcgttgatccatttcacttttacatctgcgtcaaacgcatagcccgcatggcggagagactcgacaacagaaatgtatgcgtcaggaagctcaacgtatttgccgacaaggccgattgtaatcgtttgagacaggttgctgactttgttaacaagctctttccattcggacatttccgcttctttgcatgccaatttcatgtgctcgcaaacaagcttatcaagcccttgtttttgaagctccagcggaatggagtaaaggttgtccgcatcttcacattcaataaccgcttttgtatcgatgtcgcagaatagcgcgattttatctttcatatcttgagaaatcggcatttctgtacgaacgacgatgatgtttggctgaatgcccaagctgcgcaattcttttacgctgtgctgtgtcggttttgtttttaattcgccagcagctttaatgtaaggtacgagcgtacagtggatgtacattacgttttcacggccgatgtcgctcttcatttggcggatcgcttcaaggaatggcagtgattcgatgtctccgacagtaccgccgatttctgtaatgacaacatctgcgtttgtctctttccctgcgcggtaaacacggtctttcaattcgtttgtgatgtgcggaatgacctgtacggttccgccaaggtaatctccgcggcgttcttttttaagaactgttgaatagattttacctgttgtcacgttgctgaatttattcaggttaatgtcgataaaacgctcatagtgaccaaggtccaagtctgtttcagcgccgtcatccgttacgaatacttcaccgtgctggtacgggctcattgttcccgggtcaacgttgatgtatggatcgaatttttgaatcgtcacgttcagtccgcggtttttcagcaaacgccctaatgaagctgctacaataccctttccaagtgaggatacaactcccccggttacaaaaatatatttcgtcatttcgtttgctcctctcttcgctcttagctacatttttaaaatgtactattttataaaaaatcatttagccttttaaatgatttataagaaaaatgaggggtgaaaataagaaagctccctttcaatttcttgaaagggagcataacgtactatgttctctcttcgtttttgaagagcccaaaatacatactacctagttcgactatgaaagtcaagatcgttttgaagatgaaatctgatactatttaatttcctcttcttcatcatcatagtcttcatcatcttcatcaataatatcttcttcgatctcaagatcatcgtcgtcttcatcaagatcttcttcgtcaaaatcgtcggcttcaagatcgagttcttcctcaacttcatccaaatcaaggtcgtcttcgtcgatctcttcaaactcgtcaagatcaagatcttcttcgactgctttcttcgcttttttctttttcgccttgactgtcggctgagtttcttcatcaagctgatcatacggataccagctgcgaagcccccacgtctggtcagaaagcgccaggaagcggccgtcaatgtttaaatctgtataaaattgagcaatgcggtctccaagctcttcttttttcacgccgagcaaagatgcgatttcatttaaaagctcctgaaaaggaactggttttttatgttcttcaaataattcgtgagcgatttcaactaaagccatttcctttagctcttcctgtgaatattgtttgatacccaaggtcggacactccctttctattacttatatgtatctgttttatcaataatgaaagcgattttgtatcgttcttatacaaaccatacctctcattataaacaaaataaaacagaatatgctacccttaacagcgttaatttaaataattttacaagagtgatccgactgagagatgttttccgttaatccgcgagcattctggagatgaccagtctttgaatttcttgagtgccttcatagatttgcgtgatttttgcatcacgcatatagcgttctaccggataatcttttgtatagccgtagccgccgaaaatctgcactgcttcggtcgttaccttcatcgccgtatctccagccatcagtttggacatggcggaagcttttccatatgggaggcccgatgattctaaccacgcagcctgataggtcaatagccttgaagcttctatcattgtcgccatatccgcgagtttaaaagcgacgccctgctgctcggcgatcgattttccgaattgctttcgctcttttgcatattgaagcgccgcatcaagcgctccttgggcgatgcctacggcttgtgcagctatgccgtttctgcctccgtcaagcgtcttcatcgcgattttgaagccttctccttcttctccgagacgctttgatgcgggcactacacaatcttcgaacatgatttccgttgtcggtgaagaacggatgcccagcttcttttctttcttgcctgtaaaaaatccttcaaaatccttttctactataaaagcggtaatgccttttttctttttctcgggatcggtgacggcaaaaacaatgtaaatatcagcaacgccgccgtttgtgataaacactttggaaccatttaacacatagtcatcgccgattcgttcagcagttgttttcatgctgccggcgtcagagccagaccctgcttcggtcaaagcgaatgcgccgattttctctccgagggccagctgtgttaagtactctgtcttctgttcctctgtcccaaaggcaaacagcggccagctgcaaagagagatatgggcggaaagcgtcacaccggtggaggcgcacacttttgacagctcctccaccgcgataacgtaggccaaatagtcacttccgattccgccgtaatcttcaggccacggaattcccgtcagccccagatttgccatttcccgaaacaactcgcgatcgaagcgttcttgttcgtcccgttctgccgctgtcggggccacctcatgcttcgcaaaatcgcgcaccaattttcgtatcatctggtgttcttctgataatgaaaaattcattgcttctcccccattttcagatcagcgcctaaaacggattgagccagaagctcgacgacatcgtacgttttgacttggtcttcggcttccttcgcctttgtgccgtccccaagcatcgtgagacaatacggacagccagaactgatcaccgatgggttgactgcgagcgcttgctctgtcctggcgacgttaatcctgttgcctgtttcttcctccatccacattaatcccccgccggctccgcagcacatgccggtttcccggtttctctccatttcaacaagctgcacgcccggaatggctttcaaaatctctctcggcggatcatagacttcattgtaccggcccaaatagcacgaatcatggaaggtaatcgtctcatgaagcgggtgctgcggtcttaattttccgtttttcacaagctcggccagcacttctgtatgatgataaacctcgccttcaaatccgaaatccggatattcgtttttaaataaattgtatgcatggggatcgatcgtaacgatttttttgacatcatttttttcaaattcagaaatattcttctcagccagctcttggaacaaaaattcatttccgaggcggcgcggcgtgtctcctgaatttttttctttattgccgaggatcgcgaaggacacgcccgcgtgattgagcagcttggcaaaggaaattgcgattttctggcttctgttgtcgtaagaccccatggagcctacccagaaaaggtactcaaattcttttccttcttttttcatttcttttacagtcggaatctcagcatccggcgcctcgtcacgccaattttcacgttccttgcggttgagtccccacggattcccttgccgctcaatacttgtcattgcgcgctgggcgtcactgtccatttttccttctgtcagtacgaggtagcggcggaggtcgatgattttatccacgtgctcattcatgaccgggcattgatcctcacagtttcggcaagtggtgcatgcccaaatttcttcctctgtgatgacgtcgccgatcaagcttggattgtaatcaagcgccgctgcggcttcctgcgatccgctgcccgctgacgaagcagccagctgattgcctctcgtatgccgaaacgctgctgcgggcacccatggggagcgcgaggtgacggcagcgcctttttccgtgagatggtctctgagacgcaaaatcaagtccatcggagaaagcatttttccggtgcctgttgcaggacacatatttgtacagcggccgcactcgacacacgcgtacagatcaagcagctgagaccgtctgaaatcctcaatttttcccgctccgtagctttctttcgtttcgtcggtaaaatcaattttttcaagttttccggcagattccattcgattgaaaaagacgtttgccgggccggcgattaaatgggcatgcttcgactgaggcacgtacactaaaaagctaagcaagaacagaagatggatccaccatgcgatatagaaaatcaccgccgcgcctgttttcccgacaccgctaagcataaacgcaatacctgaggcaattggctcgctccaagaaagcccatgctcatgccaaatcagattcatcccgttcccaagcagaacggtcagcattaatcctccgataaaaatgagaacgagtccggctttgaaaccgcgtttcagcctcacgagcttttcgatataacgtctgtagaatgcccacccaacagcaattaaaatgagaaacgtaacaatttcctgaaaaaaggtgaaggcgggatagaccgggccaagcggcagattccggccgggagccagtcctttgatgataaagtcaattgctccgaactgaaccaatataaatccgtagaaaaacatgacgtgaatgattccgcttttcttgtccttgagcagttttttctgtccgaatacattcacccatatggcgtgaagcctttccttgaaccgttgatcaaattgttctttctggccgagcttgatgtaggccagtctcgttttgaccaagtacacaaacaaatagacaacgtaagcggttacaatcagaaataataatgcatttgcgatgagaaagccgctcattccaattccccctttttactgataaagaccgcgatcccctacccccgaatctgtataagattatctttatgataaataatgaatgagtgttcagtcaataattaaattcctgctgttcgggcacactacctttactacggaaaggagtgccggtatgaaggtatttatcgtgattatgatcattgtcgttattttctttgccttgattctgcttgatatcttcatgggccgtgccggatacagaaaaaaggcgtacgagcctgttttttcaaaaaagaagagtgacatcgaattgatccactgcggcgctgatctcgttgagcggatgatgaatgatattcgccaggccgcctcttctgttcacatgatgttttttattatgaaaaatgatgaggtcagccacaatatgtataccttgctgaaaacaaaagcccaagctggcgtatccgtttatttgcttctggattgggcgggctgccgggcaattaaaaaaacggcgctgcagacgatgaaaaatgccggcgtccatgtccatgtgatgaatcgtccccgttttccttttttcttttttcacatgcaaaaacggaatcaccggaagattacggtgatagacggaaaaatcggttatatcggcgggtttaatatcgccgaagaatatcttggaaagaaagcgaagttcggcaattgggaggattatcatctgcgcatgatcggagaaggcgtacatgatcttcaaacgctttttgcttctgatctaaaacgaaataccggaatcgaactgggttcggatgtttggccaaagcttcagcaagggactatttctcacaagatatatgcgaccgacggttattcccttgaaaacatatacttggccaacattgcccaagcgaagaatcgccttacggtttgcacgccttattacattccatcaaaaccgcttcaagaggcccttattaacgcaagaaaaaacggcgtatccgtgagaatcattgtaccgatgaaatcagaccatccgctggtacgagaagcagcttttacgtattattcggagctcttggatgccggctgccttatttatcgttattatcaagggttttatcatgtaaaagccctcatcatagacgaccatctcagcattatcggaacagccaacttcgataaacgaagcctgttcttaaatgaagaggtgaatgttgaaattgatgacgaagcgtttacaagtgaagtctatgccacaattgaggaggatatgaaaaagtcggagctgctgacgatggaggatttcagcaagcgcacattcaggcagcgcccggcggaatggctcggcagggcattatcttatttcttataaaggagagttcctatgattttcagattcgggttcgtttcaaatgcgatgagcctttgggatgcgtctcccgctaaaacattgacattcgcgcgttattcaaagctttcaaagactgaaagaaaagaagcgcttctgactgtgacaaaagccaatttgcgcaatacgatgagaacccttcactatatcatcggccacggcattcctttgtaccgtttttccagttcgattgtgccgctggctacgcatcccgacgtgatgtgggattttgtaacaccgtttcaaaaagagtttcgggagattggagagcttgttaaaacccatcaactgcgaacaagctttcatccaaatcaattcactctgtttacgagcccgaaggaatccgtcacaaaaaatgcggtaaccgatatggcgtatcactaccgcatgcttgaggccatgggcattgctgatcgctccgttatcaacattcatattggcggcgcttacggaaataaagacaccgccactgcacaatttcatcaaaatataaaacggctgccgcaggagatcaaagagcggatgacacttgaaaatgatgataaaacatatacaacggaagaaacgcttcaggtctgtgagcaggaggatgttccgtttgtctttgactttcatcatttttacgccaatccagacgatcacgccgacctgaatgaagcactgccccgcatgatcaaaacgtgggagcggatcggccttcagccaaaggttcacttgtcttccccaaaatcggagcaagcgatacgcagccacgccgattatgttgacgccaactttttgctgccactgttggaacgctttaggcaatggggaactaatattgatttcatgattgaagcaaagcagaaagacaaggcgcttctccgcttgatggatgaattaagctccatccgcggtgtcaaacgcatcgggggcggtgcgctgcaatggaagtcataaatgtgcaaaaataggtttacgacttgtcagctttgggaacttaggctatataagacaacaatcgatggaggagaaagatcatgaaaaatatcaagtctctgaaagtagccgcacaggcctttactttaagaaatttgattcatctttataaaatgtgccattccggaagccacgaggtttatatttattcaaagaaaacgatgtgcaaaatcaaaagcttaattgagcttgaaacgttccgcatggctcataatgaaaaggaatatctgatcgtagttgaaggaacaaaagcatcacagctcattgaaaaattccaaaatctcatcgagcctgctgagagagaagcgctctaacttacatacaaaaaaggatagacatctgtctatcctttttcttatgctcttacataatggagctgaaccgcttgtccaaattgttttgtcccttttaaccgcagttttgtttcatttgttagttcgtgaaacagcgggatgccgcttcctaaaacgacgggaataacagtgatgatgaattcgtcgatggcatcttctttcataaagtcattcacaagctctgccccgccagctatccagatgtttgagcctttttcctgtttcaaacgggcagtgaaggctctggctccctcattgataaacgtcacatgttcatcttgataactgtcgggcgatcctgtaaaaacatagcaggttttatcctgatacgggaaaaccggtgttagcactttaacgtgctcatatgtgctccgccctaaaatgactgtatcaacagtctgataaaaatcactgtagccgttgtcaccttcaccttcaaattcatccagccaatcgatgcttccatcttcttttgcgatcatcccgtccaatgaaacagcaatgtacagcacagtttttctttccatgttctcctcctatcgatgcaccatttgcccgaattgcgcttgatgcagcctgctgtataggcctccggcttcgatcaggtcttgatgacggccttgttcttcaataccgttgtttgtgacgactacaattctgtccgcgtctttgattgttgccagcctgtgggcgatgacaagcgtcgtgcgcccctcagacaactcttgaagcgccttttggatcgccgcttccgtctctgtatcaagggctgaggtggcttcgtcgagaatcaagatcgacggatttttcaagaacatccttgcaattgacagacgctgtttttgcccgccggaaagcttcacgccgcgttcgccaatcatagtatccaacccatcgggcatgttatggacgagctcttccagatgcgcctgcttcacagcttgccaaatgtcttcttctgatgcgcctagtcggccgtaggcgatattttctctaagcgtgcccgagaataagaaaacgtcctgctgcacgacgccaatctgcccgcgcaacgaagaaagcgtcatgtcttttatactgatgccgtcaatcgtaatgtcgccctccgatgcttcataaaaacgcggaagcagactgcaaagcgttgatttcccagcacctgacggaccgacgaacgccaccgtttcccccgcttgaatggataggttgatgtcattgaggacattgtgatggtcatcatagccaaacgaaacatgtttatagcggatattgcccttcaggccggaaacatctctcgcatcaggtgaatcctgaatgtccggctctgtctccatgagctccatatagcttttgaaacccgcgatccccctcggatacatttcgataatggcattaattttgtcaataggcctgaacagcacatttgtcaggagcacaaacgccacaaattccccgtacgataaggagccgcgaatgacaaaccacgtcccgcacaaaaggacaaacagcgtgacaaaccgggtcagcatatagctgattgacccgtttttcgccatgattttgtaggaagaaagctttgtgacacgaaaacgctggttgttgacggcgaagcgttctttttcaaacgcttcatttccgaacgcctgcacaagccggatgccgccgatgttattttctacacgcgcgctgaagtctccgatatccttgttcagcgtggtaaatgctttggtcatttttttgttgaaataaagcgctagccaaatgacgatcggcataatgataaacgttaataaagcaagctgccagttaataaacagcatcactccgaacgccccgagaatggtcatgaccgcaatgaataagtcttccggaccgtgatgggcgacttcaccgatatacattaaatcgttcgtaagcttcgacatcagcgttcccgtcttgttgttgtcgtaaaatttgaacgagagcttttgcaaatggtcaaaaagcgactttctcatatcagtctcaatattgataccaagcatgtgtccccagtaggtcacgatatactgaagagccgagctgagcgcgtacaccgcaaataacccgattgaggtcgcgatgatcagcccccagtccctgcccggcagcaaggtatcaataaaataattgacaatcaaaggaaaactcagctccattaaacctcccgcgatcgctgagaaaaagtcgagaaagaacaacgttttatatggtttataatatgaaaaaaattgccgcagcaccctatcttcccccaatgtataaataactgataatatttctcaattatactatacacgggctgttttgaaagatcagatttcttttttcttacagaacacctgaaaacaggcgggcaaatgactcttttgtccggtcagccacgcctcttttataaaagccgacagggctgagcttttcactttcctgcatatcctcttcaaaatggacctcaagggttcggatcgcttcggcatccgtgaagaacacattcacttcaaagttgagctgaaagctgcgcatatccatattcgcggtgccgacggaggcgagatcgccatcaatgatcatgactttttgatgcatgaagcctttttggtaggagtacacttcaatgccctcaaggagcagctccgggaaataggacctcgacgcgtattgggtcaaaaagctgtcgttcttctccggcaccataacccttacctctaccccctttgtcgccgctgcttttagcgccgtgcgaatggattcattggggacaaaatagggcgtggcgatccatattgatttctgcgctgaagaaatcatttcataataaaggtcgctcatgctttctttcatgtcagggcctgtcgcgacaatttgataaatgcctcctccttccacgggaaccggggtattgtactcctcttgatcaattagcacttcattggagacgtattcccaatccagcataaagatagcgtggagcgtttgcacaatttccccctcaagccgcaggtgtgtatctctccaaaatccgatgtgcggatctctgctgatatattccttcccaacatttaatccgcccacaaaaccggttttcccatcgatgatcacgattttccggtgatttctgaaattcagcttctggttgaaaaacccgtatttcagcggagaaaacgggacgatgtccacccccgcttgtttcattctcataatatctcttcttgccagcttcatgcttcctgccgcatcgtataaaaacctcacctcgacaccctggcgcgctttctccatcataatatccatcatgccgcgtccgagcatgtcagatttaaacatatagtattcaatatgtatgtaagattccgcttttctcattgctttgaaaatgtccgggaaggtttcttcgccgtttttcagcactttgatgttgcttttcgtattgatattcatatgggcagccctgatggaatatgtaaagaacctctcttgattgtccttcagccctgtcacttcgggcgtttccttcttgtcaaacagcttcctgagcttttccctgttgtacattcgttttgtcttaaacagctttccctttacataaagctgtcccgaaaacagataaaacacgtagccgacgattggaaaaaagacaagaatatggatccatagcagcgtgtgctgcgaggtgcggttttcaagaattaatgaatagatgctgaacaaaataatgcttatatagcaaagcaatcctccgtaaaactcaagcctggaaaccggaaaaaaccaaatgacatatgccccgatgagcatcatatataaaaagaaaaattccagtctccttttcagcatcctgattctctccaatctgattcaattacctctgtattacctcttttttctaatcgataaaccttgtaagtaaataacctctccgccgaaggaggagaggtttagaaaaactaactgtcacggaattcatccgcatcgtttctgcagaaataaagcaagactattggcaacgccgagtgaagtctgatgatacaacatgagcggcaggccgaacccgctcagcactccggcaagcgccgaaaaagaggcggcgctgtgactgcaaatacggtggatagagtgaatttgatgcccactctgatgagagaaaatatataaaacgggatattgatcagaaagatataaggagttagtcaggctgagtcataatctgctgttccgccggtttaaaatgagtaaaatccgttttattcttgatcttatttccaaatacaaacacaacaggattcccggccgcccagccattacctttgcagaaaaaaccccctcctgggggggattttcatgagcgtttccgatatacaacgtagctgcgggtcagatacttgagcggcagactgaacacatgaaccaatcttgtaaacggccacaggataaaaacgacgtatcctatcacaatatgaaacttaaaccatagcgggacactctccatcaaagaggcgtcaggccggaacaaaacgatttccctgaaccagggcccgactgtggtccggtaatcaaatcctttcgaatcaatgttgagaaacgtggccgcaacgcccgacagcatcatgaacagcagcaggagcagcgtaaggatatcggatggcgagctcgttttgcggattcttttgtcaaacagccttctgtacgtcaggatgacaagtccggtacatgccgcaatgcccgccggcaagccagcgccaatcgccattttgtgatacatatgctctgaaatgccaagggaagcatacacgccttccgggatcagaatccccatgacatgcccgccgacaacgcacagcagtccccagtgaaaaagtgtgctgcccgccgcaagttttttcttttctaacatctcgcttgatttcgccgtccagccaaattggtcatgctggtagcggtaaatatggccgccgataaagattgtcaatacaatgtatggcataataccccagaggatctgcccgctcatgcctgaacagccccttcaacgctttcacgtacgccaatgttttcaagcgcggccagcagcacgtgcagcagttcagcgtatatactgtcatttttttcgagacgggatgccagctccctcacattggacagatatttctcaaacacgcttctcgctgcttcaatttctgcagccgcagcaaattccagcatcagcggcagataatcaggcagctctttctctgtcggcaggaaaccggattgctcgtatgtgttttttaaatgcagcaattcaacgccgcgttccctttgctcgcccgagttaaagtaggtgacatacatatttgtttttttcccaaagtcgaacgtatagacatagtgttcaatcagcgcttccggtgaaaagctggctgacgcctcgaaaaagtgcagcagcttctcccggatttgccggttgctgatttcatggataagagccttccaatcgggaatctcggctctccactcttcatccggataagagagaagagaggaaagagcggagaacgtcatttgccggtctgtggtgttcatcttgttacacctcatttatcaaaagttagaaacaggagccggggccgcctgaaaatgataagccgcagctcccttgttcagcatataaatctgaaacttcttctcgatgactgctcggtatcacaaagcggtcatcatatttggcaatcgcaagcagccgatacatatcttcaatttgctgttctgttaagccgacactggagatcagttccggatcgattgatttattcgtctggatcgctctcatatactggcgcatgacagacattttctttaacgttgaccgaatatgatccgtatcaccggctgttaacagctgcgccaaatagtctatcgggattctcatttggtcgatagccggaaaaatatcttccgcggattgccggctgccttttccttcaaagagattcataatcgggctgagcggcggaatgtaccacaccatgggcagcgtgcggtactctggatgaagcggcagcgcaatcttccagtcaatgatcattttatagatcggcgattgctgcgcagcctctatccattcagccggaatgccttgttcttttgccagcttggcaacctcaggatcatttggatcaagaaaaacgtccaattgggaatggtagagatccttttcattttcaacagatgccgcttcctccactttgtccgcgtcatacagcatgacgccgaggtagcggattctgccaacacacgtctcagagcagatggttggcagtcccgcctccaaacgcggaaagcagagtgtgcatttttccgctttgttcgtttgccagttaaaatagacttttttataaggacaggatgagacgcaatatctccatgaacggcatgcgttttgatccacaagcacaatgccgtcctcctcgcgtttgtacatggcgccggatggacaggatgagacgcacgccgggttgatgcagtgctcgcaaatacggggcaaatacatcataaagacctcatcgaattctgttttgatcgattcctccatcttttgtacgttgggatcttcaagtcccgttatgtggccgcccgcgagatcatcctcccagttcggtccccattcgatattcataaaatcccccgttaaggacgatttcgggcgtgctaccggctggtgttttttctgcgggctgttcgttaatgtttcataatcatagttccagggctcatagtaatcatcaatcgacggctgattcggattatagaaaaggcctgcaagccgattggttttcgagcccgatttcagctcgagctttccttttttcaatgtccagccgcctttatatttgtcctggtcctcccattgcttcgggtagccgatgcccggctttgtttctacattattgaagtacatatattccgcaccggaacggtttgtccacgtgtttttgcaggtgacgctgcacgtgtggcagccgatgcatttatccaagttcatgaccataccgatttgcgctttaatcttcaagccaatcgacctccttcagcttgcggatgacgacgttcaggtcgcgctgattccccgttggaccgtaataattaaagccgtagctgagctgggcgtagccaccgatcatctgtgtcggcttgacgtgaatccttgtcgggctgttatgggtgcctccgcggttattcgtcagctttgtgccgggcacgttgatgtggcggtcctgggcatggtgcataaacgccattcctttaggaatccgatgagacaaaacggctctcgcgacaacaacaccgtttcggttaaagcattcaatccaatcgttgtctttgatatccgtgtcctctgcatcatctttattcatccacacggttggcccaccgcggaacagcgtcagcattggcagagaatcaaaatacatgctgtggacagaccatttattatgcggcgtcaaataattgaggacgatttcttttccctcttgatcaggccgcttgctcagaaacgggcgatgctggaggatcggtttgaatgtcgccatcgtttcaccgaattccatcatcagttcatgatcgacataataggattgtctgcctgtcagcgtccgccacgggattaatttttcaacattcgtcgtaaacggcgaatacctgcgccctcctttttcagagccggaaaacgctggagacgtgatcaccgttttcggctgggctgtaatttgttcgaacgtaaagcactcttcctcgcgttcttccgccaggtctttcagcttcaggttcgtgatgttttcaagtgattcccatgctttgacggcgacctttccattcgaagtggatgatagggttaaaaccgcttctgccgcctgctttgcttcacttatatttggacatccctttgccacgctgtctgaggtgatttctcccagtctctttttgagtgattcatattcatcggctattgaccagctcatcccttttgttccgctcggctttaaagcagcgttaggaccgagtgcggtcattttatgaaaaatgtgtttgtaatcccgttcaacgacttggatgttcggcatcgtttttcccggaatggcttcacattcgcccttgctccagtcattgattttgccgaatggctgggccaattcctgcatggtgtcgtggaggagcggcgtcgcaaccacttctttcaccggctccatattgacttcttctgccagatcggaaacggcttttgacagcgccttgaaaatatcccagtctgacttcgattcccacggagctgagatcgccggagcaaatggatgaatgaacggatgcatatctgtgctgctgagatcgtgtttttcataccatgtcgccgccggcagcacgatatcggaatacagcgccgtacccgccattcgaaaatcaagattgattaataagtcgagctttccttccggcgcctgctcccgccatttgatttcttctgggcggatgctgtcgctgtcgtcattcattaaaccgttcgttgtccccagcaaatgcttgagaaaatattcatgcccttttcctgagcttgagatcagatttgcccgccatacaaagagattccttgggaaattcacttcattgtcaggatcttcaatcgcgaatttcagttttttctcttggagctgtgaggccacgtacgcacctacgtcttcaggtgttgctgcccctgctttttcagcttctttatacagatcgatgccattttgattgaaagtcgggtaagacggaagccaccctagccgcgccgccagcacattgtaatcagcgtggtgcttgtagcgggatgacgcagcaatcggtgatgccaaatcactgatcggctggtcctcataacgccactgatctgtcgcaaagtagaaaaatgaagtgccgttttgcagcttgggcacgccctcccagtcctttgcagttgcaatcgtctgccatccttcagcaggtcggagcttttcctgcccgacgtaatgggcccagcctccgccatttacgccttgggcgcctacaagcaaaacaagatttaacactgctcggtagatcgtgtcggagttgaaccagtggttaatgccggctcctacgataatcatagaccggccgtctgtatcgatcgcattttgagcaaactctctggcaatcttaacgacagcttcttttttgattcctgtcatttgttcctgccaggcaggcgtaaacggctcaggatcatcataggagacagcttgttgttcgccgatgccccgatttacgccgtagttagccagtatcaagtcaaacacggtcgtgacgtacgtctcttcaccgttcaggttcatttttttaataggaagatcccgctcgagcactttgtttccgtcatttgaaaaatacgggatgcgcaccgtgccgatttcatcctctattccgagcacagagagacggggttcaatcggttccccggtttcttcatcaatcatgtgcaggttccatttctgctgcccgtcccagcgcgagcccattgtcccttggggtatggcaaatgaacttgtctgttcatcccaaaccgcaggcttccactgatcatgctttgtcttccgcccgatgtccttcgcatgcagaaaccgtcccgctgtgtatacgccattttcttttgacagagtgacgagaaatggaaaatcagtgtattgcttcgcgtactcaataaaacgttcagtttcttggttcacgtaaaattcctgcagaataacgtgacccatcgccatcgcaagcgccccgtcagtcccttggcgaatactcagccagtcatccgcgaactttgaggattccgcaaaatctggactgatcgaaatgaccttagcgcctttatagcgggcctccgccaaaaaatgcgcgtcaggcgttctcgttaacggaacgttggagccccatgtgataatatagccggaattgtaccaatcactgctttccggaacgtccgtctggtcaccccaaatttgcggggatgctggaggaagatccgcataccagtcataaaaactgagcatagggcctccgattaacgacataaaccgggagcctgatgcgtggctgatcatggacatggccggaatcggagaaaaaccgacgtttcggtcaggcccgtatttcatcactgtatacagcagagaggctgaaatcagcttcagcacctccggccattcagcgcgcacaaaaccgcctttccctctcgcctgtttataggacttcgctttttcagggttttcgacgatcgatttccaggcttccaatggattttgatgcgtctgcaatgcctcccgccacaaattgatcagcacaccgcgcacgtatggatatttcacacggagcgggctgtagatataccatgaaaaactggcccccgcgggcagcctctcggttcaaaatcaggcatatccgggcctgttgatggataattcaaattttgcccttcccacgtgacaattccgtttttcacataaatattccagctgcaagaccctgtacagttgacgccgtgggtggagcgaacgactttgtcgtactgccatctgtttctgtatacattctcccaatcgcgatcctcgcgggtagtttggctatgtttatttgaatggtgttcgataggagagaaataattcaatctcctaaacaacggactcattttctttttcttcatgagagttcactccttccgagtcaggtgatgctaagttcactataaacagagacagcgtgttttcttgtgaactatgtcacacactctgcttttttcacaaaatgttcacacaaaggagaaggaaggctgagttcaggcaggacgcttgggtcattagctgcctttcattcaaagatcaaaaaaaaccggctctatttaagaaccgggctcggcgttttcatcctgtgatgtatgcagataccgcaaaaataattgataggaacaaaaaacattttgctgaagcatagccaaaaagttcatttgcagctgcggatgataagacatcattttcttaaatatgtaatatgggatgttgagaatcagaatgtctgaagtggcattgactgagataaagggcgataaataaagcccgcctttttcatcaatcggaaacacatcgcctttttcccacagcgcaacggttttcgacccttcagggagccttgtgtccataaaacggacactgccttttaatacaatataaacagattgagaatgaagaaaagatggagactgatcacatgaaccgcggataaacgtgccgtttttcagcaaggtttcgacaatggatagaggcacttcattaaacataggaagttgtttcagaaataataaatagtcacactgattcataggaaaacctcctgtgctaagctaaggatagctttagtgtagctcgactgagcctgtacagcagtgatgtatttcacagcctgtatgatgaatgtcacttatcaggagggtgaatgcatttataatgaaagaaaaaaggaggatttcgatgaaggcgctgattccgaagcagcacggggcgtgggcgatgctgctgatcccatttttactcggcatggtcaagggaggccccgttatttggcatattccgctcttcctaggctggcttttcctatacttagcggtttatcccgttacgcttgccttaaaaaagaaccaaagcaaaccttatcaaaagtggatgtgttattacggttttcccgcctgctgctttttgatgatctcggtctttcataagccgcctctcatctgggtgggcgtttctttactgccgctgtttctcatacatatgtattttgcccgcagaaaaaaagaacgagccctattgaatgatgttgcaggtgtcttgttcttttgttcgggcgggtttgcgagctgctggctggggatgggaaccctcgacggctgggcttggtttattttcttgcagtctgctttattttttatcgggagttccttttatgtgaaatcggtgattcgtgaaagaaaaaacaggacatttgcatactggtcatggggatatcacctgctgctcccctttttatccgctcttttcggagcaggatgggcgtttctcgcttttatcccgagcagcttgcgggcatggttttttcatggaagggattggcccgtaaaaacgattggcattctggaaatcgtgaatgcctgtttctttcttgccgtcatgtgcctgtttatcacaaggtaaaaaaacaaggacaccgctgtccttgttttttcagtcaatattgcaaatctccagcgggcaattttcacactcaatctcacatcgtaaatagtcccgcttgtgcaaaataatttttccggattcgtctatcgaaataaccccttttttgcggagatctcccagcatacggttgatgctttcccgtgcagccgcacaaaactttgccaaatcctgatttgtcaggacaatgttaatcagaatgccgtcgcttcgctccactccgtagctgtttgataagcggataagggtagaatagagcgccccctttttgccatgaagaagcagatccctgattttggactgaatcttccggaggtgcgtgctcatccatttcatgaactcaaatgtcaaagcgccgttttggattaattctttttccagcttatttttattaatgacgagcacctcgccatcctctagtacttttgcactgagcatataccttggttcttcagtgaaaagtgttaattctccgacgatatcatgcttttggcagattctaagcgtcaggtcttttccgtcagatgtcagcttgccgatttcaatgagtcctgattgaatcagataaagctcttctgcatccattccttcccgaaacaaatacgtgtgtttttccatttttcttttcgtgctgatcgattccagcaattcatacagatcgctggatatatgatcactatcagatggtcgaacagagagaaaattcatgagctcacctcgaagaaagtcacgttgtgtgtttattgtaacgtgaattgatttgtacccatcgagaaaaaactaacaatcttgtgaatgccccagtgttagttgatgctctggctgtttctctccgtgtgtgttttcattctttcctgccaatacatccatatgacaaggacaaaactggctaacgccacctctgaaagcgccataaacccgatcgcgtactggcctgttgcctgaaatacactcgccaatatgagcggaggaaaaaagccgcctaaaccgcccatggcagacacaatcccattggcaatccccgcttgcttcgaaaaatagaaaggaaccagtttaaaaacagtcccatttcctacgcctgagcagacggccacggttaatgatccaaacgtataaaggccgattgtcggcgagaacgataggataatgcctgataatgtaagcccggcaaaaacaaacatcaagatgcggagcgggctcattttatcagccaggaatcctcccgcaggcctgagcagcgtagaaaccgcaataaagccagccgtccgcaagccggcatctgcaggattcagcccaaaatgctccaccagaaagttcggcagatagatagtgaaggcgacaaaggcaccgaacgtaataaaataaaacaggctcagaaaccatagcacatgatttcggtaaacagctttgatttgagtcttaacagaaactttgaccttcttctcatgcctgtcgccaaacaatacgtgcagtaaggcaaagacagacagcaaaatcagatacatttgcacggttgatttccacccgacggcttgagcgataaccggcgctgcaaatgtcgtaacggctgtcccgatatttcctgcaccgtaaatcccattgacgacaccgtgcttttctttcggataatatttcgggagggaggtcaccccaatggaaaacaccgctcccccgatccctaagaaaaagccgcctgcgattaaatcaaacagagaatccgcgatactgatccaaaatacaggaaataaaagcaggatgaaactgaccataaacatgagccgcgcgccaaacctgttcgttaaataccctaaaggaatgcggagaagcgacccgaggatcacaggaatcgccgtcaccaaagaaatctcacccttgcttaaatgaatatctaatgtgatttgggaaatgagtgatgaaatcagcacccaaaccataaaccctgccaccaagcttaatgactgtaacgataattgaatgtgttgacggttgatcatttggcttgcccctttcaatgattcaataatcagtcttatcatacaaaaactcggcaaacaggattgtgaattacatcacacgtttttctcataaaaaaaggacaaagcccgaagactttgtccttttgatcgtgattacattttttccggagccgatacgccgatcagctgaagcgcattgttcagcgtaatttgcgttgccttcattaaagccaggcgcgcgcggctcttctcttcattttcagggtcgatgactttctctgcgttgtagaagctgtgcagagcagaagccagatcataaatatagtttgtgacacggtgcggaattcgtttttccgctgcttccgccactgcctctgggaagccgccgatcgttttcagcagatcgtattctttttctgattgaatatggctgaaatcaagatctgccgccggtttaagtccctgctcttccccttggcgaagcatgctgcaaatacgggcatgcgcgtattgtgcataatacacagggttttcgttagatgttgatacagcaagatctaagtcaaaatccatatgggtgtccgcacttcgcatcgcaaagaagtaacgaacggcatccaagccgacttcttctatcaggtcacgcatcgttacggctttaccggtccgtttgctcattttcattttctcgccgtttttgtaaaggtgaacgagctgaatgatttctacttcaagcgttcctttttcatagcccagcgcttcaattgccgctttcatacgcgggatgtagccgtggtgatcggcgccccaaacgttgatcagcttatcaaagccgcggtcaagcttgtccttatgatacgcgatatcaggaagcaggtacgtgtacgtgccgtccttcttgatcaatacgcggtctttatcatcgccgaacgtcgtggaacggaaccaagtcgcgccgtcttcttcatagacatggcctttttcgcggagcgcttcaagcgccgtgtcgatttttccattttggtacagtgaagtttcggaataccacacatcaaacggcacacggaagttttccaagtccttgcgaagcttgtccagctcgtatttcaggccgtattcacggaaaaacgcgaggcgttcactttcctcttcgttaacgaaacggtcaccgtattcctcagcgagacgctttccgatcgcaatgatatcctcgccgcggtagccatcctccggcatcggtttttccaatccgagcgcttcaaagtaacggacttcaacagaaagcgccagattgttgatttggtttcccgcatcgttaatgtagtattcgcggcttacatcgtaacccgcttttgaaagcacgttgcacaaggaatcgccgacagccgcccctcgcgcatgcccgaggtgaaggtctcccgtcggattcgctgatacgaattctacctgaactcgttcaccgtttccgatgttcgtttccccgtatgcttcccctgcttccagtacagacggaatcagctttgttaaatattgattgttcatatagaaattgataaaacccgggccggcgatatccagtttttcaatcgaagcctttcctttatcaaaatgggcgacaatctcttcagcgatttggcgcggcgctttttttgccactcttgccagctgcatcgccatattcgttgagtagtcgccgtgtgttttatctttcggtgtttctaaaacaacattgggaatctggctttcttcagccagtcccgctttcagaacggccgctttaatttcttctttcagcacgtccttcatttgttccgcaatgttcatgcgtgagttcctccctcatacgtgatcgtcatattatgtaaatgctcctgctcgtctccgacatgcatgtcatatgcgatgctgatacggcctttttcttcatcgagatcagattgaatcgattttgtgcttgttttcagctcaagctcaccaaatgacattttatatttagcaattgtggaagctcccgttacgaaacgctgattcattttgacagcgcctgacctcatgaccaggacttcgccttcgcttactttcacaatcgttttgactttgcctaagtcgtgttcttcataataagatagatacactttattttgttttacatagtaaaatccggtggtgcggaattcgatgacttcttggtttccgtcatcctcgatcacagacttcacatggagtgttatcggtgtctcttgcttcattctgacacgtccttttcatcattccactttgacttgaatagtataatcattcggtttgtaaacttcaactgcttctatcttaccatcattgctcatcagatttgaagataaacctcataaaaagcatttccttatatagaagagaaaatcatatcactaattacctttaggaaatgttacatttttccgaaatctatcatttccttttcacatttttttcaaaatatatgtattgaattagtaatttgatagttttaagataaaagtacaacatagatctgctagaaaaacaaaaaaagggaggattcaattatgaaaaaagctgtcattgtagaaaacaaaggttgtgcaacatgctcgatcggagccgcttgtctagtggacggtcctatccctgattttgaaattgccggtgcaacaggtctattcggtctatgggggtaaggatctcccaaaagggcatagtcattctactatgccctttttaagtaaattacaatttttaactaaaatctacctcttggatatacatacacaaccgtttttcatttgaatcatatgtataggggatggtattttgtttatagagcagatgtttccatttattaatgaaagtgtaagggttcaccagcttcctgagggtggcgtgttagaaatcgactacttgcgcgataatgtctccatttctgactttgagtatttggatctcaacaaaacggcttacgagctttgcatgcgcatggatggccaaaaaacagctgagcagattttagctgagcaatgtgcagtgtatgatgaatcaccggaagaccataaagattggtattacgacatgctcaacatgctccagaacaagcaggttattcagcttggaaaccgggccagccgccatacaatcaccacgagcggaagcaatgaatttccgatgcccctgcacgccacctttgaactgacgcaccgctgtaatttgaaatgcgcccactgttatttggaaagctcacctgaagcgctcggcaccgtgtcgattgagcaattcaaaaaaacggctgatatgctgtttgataacggtgtattgacatgcgaaatcacaggcggagaaatttttgtccatccaaacgccaatgagattcttgactatgtgtgtaaaaagttcaaaaaagtcgctgtcttaacaaacggaacactcatgcgaaaagagagtttggagcttttgaaggcttacaagcaaaaaatcatcgtcggcatttctcttgatagtgtcaattccgaggtccatgactcctttagagggagaaaaggctcttttgcccaaacttgtaaaacgataaaattgttgagtgaccacggtatatttgtcagagtcgccatgtctgtcttcgaaaaaaacatgtgggaaatccacgatatggcccaaaaggttcgggatctcggggcgaaggcgttctcttacaattgggttgacgatttcggaagaggcagggatattgtccatccaacgaaagacgccgagcagcaccgcaagtttatggaatacgagcaaaatgtgattgatgagtttaaagatctgattccgattattccttatgagagaaaacgcgcggcaaattgcggcgctggctggaagtccattgtgatcagcccgttcggcgaagtacgtccttgcgccctctttccaaaggaattttcattgggaaatatttttcatgattcctatgaaagcatctttaactcccctctcgtccataaactgtggcaagcgcaggcgccgcgcttcagtgaacattgcatgaaagacaaatgcccgttcagcggctattgcggaggctgttacttaaaagggctgaactctaacaaatatcaccgaaaaaacatttgctcttgggcgaaaaatgaacaattagaagacgtggtccagcttatttaggagggaaacgatttgtcaccagcacaaagaagaattttactgtatatcctttcatttatctttgtcatcggcgcagtcgtctattttgtcaaaagcgattatctgtttacgctgattttcattgccattgccattctgttcgggatgcgcgcgcggaaggctgactcgcgatgagcattttggatatacacgatgtatccgtttggtatgaacgggacaacgtcatcttagaacaagtagatttacatttagaaaaaggcgccgtttacgggttgcttggggtaaacggcgccggaaaaacgacactgattaatacgctgacaggcgtgaaccgcaatttcagcgggcgctttacactgtgcggaattgaagcggaggccggcatgccgcagaaaacatcagatcagctgaagactcaccgttacttcgccgccgattatccgctgctatttacagaaattacggcgaaggactatgtgtctttcgtccattcgctttatcaaaaggatttttcagagcagcagtttgccagtttggccgaggcctttcatttttcgaaatacatcaacaggagaatttcggagctgtccttggggaacaggcaaaaggttgtattgatgacaggcttattgctgcgcgctcccctatttattttggatgagccgctcgtcggtttggatgtggaatcgatagaggtcttttatcagaaaatgcgcgagtactgtgaagcaggcgggaccattttgttttcttctcatctgctcgatgtcgtgcaaagattttgtgattacgcggctattcttgacaacaaacagatccaaaaggtcattccgattggagaggagaccgatctgcggcgggaatttttcgaggtgatcggccatgaataacataatccccatcatgtctttgctgttcaaacagctttacagccggcaagggaaaaaggacgccatccgcattgccgcaggccttgtcattctggccgtgtttgaaatcgggctgattcgccaggccggcattgatgaatcggtgttgcgcaaaacgtatatcatactcgcgcttctcttaatgaacgcatatatggtgtttctttctgtgacatctcaatggaaggaatcttatatgaaactgagctgcctgctgccgatttcttcacggagcttttggctcgcccagagtgtcgttttgtttgtcgatacctgtttgagaagaactttattcttttttattttaccgctgttcttatttggaaacggaacgctgtcaggggcgcaaacattgttttggctcggcaggttttcgttttttaccgtttactccattattttcggagttgtgctaagcaaccacttcgtcaaaaagaagaacttgatgtttctgctgcatgcggcgatattcgcctgtgtatgtatcagcgccgctttgatgccggccgccacgcttccgctttgcgcggtgcatatgctgtgggcggtgatcattgactttcctgtctttctgcaggcgcctccgcagcagagcaagatgcattcatttatgcggcgatctgaattttcgttttacaaaagagaatggaaccgatttatctcttctaaagcgatgctgttaaattacgcggtaatggcggcgttcagcggcttcttttcgttccagatgatgaataccggcatcttcaatcagcaagtggtttatatcgtgatttccgcgcttttgctcatctgctcgccgatcgcccttttgtattcgattgaaaaaaatgaccggatgctgcttatcacgcttccgatcaagcggaaaacgatgttttgggcgaaatatcgcttttattcaggcctattggcaggcggatttctccttgtcgtgatgattgtgggtttcatcagcggccgtccgatttcagttctcacttttttgcagtgcattgagttgctgctggcgggagcttttatcaggttaactgcggatgaaaaaaggccctccttcagctggcagacggagcagcagctatggagcggtttctcaaaatatcggtcttatctgttttgtcttcccctattcttagccacattagccggcaccgctgtatccttggcggtcattccgatagccggtctggtcatagtctattacctgcaaaaacaggatggtggtttctttgatacaagcaaaagagaacggcttggaagttaacctgctgaagactcatcaattttcaactatttcaatcgccgcgagctttctgaaaccgatcgaaagcgcggcggaacctgaggaagaaacgatttatttttacggcgccgccgcatacctgaaggagcaaattattgacgctttcggttgtgctgccggcagccgtttcatgtactcagcgaatctcttttttgatcagcagctgaaaacctgcgggacccgtttgattcacccattatataacgggaatcttcatgttgacgccctgctgaaaacttttgcagacttgtctttcccttcttctctttcattcgaagcagttgaaaaggccaggaatgagctgctgctgagaatcgaaaagaaattcactgatcctttctcctactcggcggcgcgcttggctgaggaggtcttcggaaacccgatgtacggcacaggcatgtttggccggaaagacaggataaaggcgattcatcctaaacggtttctcgacgcaacggactttatcgttgatttagtgtcccagcaaaaacagctgaacatattgggacaagtacaagcatgtgatgttcggggacatgccccgcaaacgtccgctgtaacgtccgaaagaatacccgtaaaccggcatgtttttgaaacagagacacgcagcgctgcaggtccttccgtcttgacactcggatttgactgcggagagatgaaagatgccagcgattatatcaaaatacagctaatagacggattactgggaaagtacggccattccgctttattcaagcacttcagagagaaggatctggcagtctatcacgttatcacccgttacgatgtcatgaacaatttgctgcttgtttcaatatgtacagatcagcttcatgagatagacattcccccgcgcgttttggaagctgtctcagcttttcatacagatgagcgggaactagaacaggcaaagcagtttttacgcaatgaattgctgctgcaattcgattctcccgaaggtctattggcctatatggggatcctgcgccgcttctcctgcacgaaagaagccttgctggatggcatctcagcggttacatgccgtgatgtattgcaattcatagcgaccatcaattatatcggagctcatgtagtaaggggatgaagagatggaaaagaaagccttttttcaacaactggatgaacgaaccgatatcagatacacagacagcggactaaaaatattcagattgaaattcccccgcgcccacctgcggctgtgcaatgtaaaaatcgattttggaagccgggatgtatgtatacgggcagaatccggtgatacactgcttccgtatggcacagcgcattttttagagcatcttctcttctggcataacggccgcaatctgtacagtgatttttttgcgcatggcgcgcttttaaacgcattcactacctacaccgataccaatttcatgtttacctcattaccggatcggctcagacaaacgatccccatcctgcttgatgctttatggaaccactcatttgacaagaagattgtcgctcaggaaaaagctgtgattacaagcgaaattcaaacagcacaccttaaccatcagctctcatatcattatcagctgatcagcatgctttctccctcctcaccagctgccgttttccccgcaggcagaatcgaagatattgaggcgctggacatcagtgatttacaaaaagcctataaggctgcctaccaagcccatcggatgacgctgtttttgattgggggctcagaaaatacagaaacgcttttgcctcctcacctccagctggaaaaacgtccggattatcatgctgaaagaaaaatcatcccggcatgccctccagccctctcacaaaaaatggtgctgggtgatgaggagcggatggaagatacatggaccggattacagatcggcgcacttcccgggcaaaacgatctgttggcgataaagctttattgggatatcgcggctcgtattctatttcaattagattcaccgttttttcaagagattcagcaaacgtaccgtctggaaatcgatcgcttgtcagccgagacttatatatatgaggatggcggtttcttgatccttcacagtcaagggacccattcttcagcttatatcgatgtggcttcatactatgtcacacagaagaaagaacaggttgccgcctggcttcaatacggcaaggactctttgacagacgcgatcatttatgacagcgattatgtgcgtaaatgcttcgagtgggcagccgagtgtgacaggtgcgattgctcgtttcttgacatgtaccacatcattcaagatatggatgcgcaggttttcttgtctctcattgatgcaatggcatcttctaacaaagcgatcattcacgtttctcagaaagaggcgatcagacaatgaaaaaaagcactgtctttacccttttattgctgcttataggtatggcggcttattccttcggatgggttcaggccgttgccgaagccgccgcccaatatgtacagatgatcaacaatgatgctgttcggctcggactgctggcttgtaccgctgccctcctgatgctgcctgcttttctatatcttcattatgtcacccaatccgtgaaaaacatgacagcagcttttcagaaactcacacagtctcatcaaagctgctgtgactttcagcaacacaacttgtgcagccgatatgcagaagacgtcaaatcgctgcgtgacagctataaaaacgtccgccaaacatacgtgatggctgccgtgttgtgccaagtcatcatattcggctgcatgttcgaaatcgttaaagccgtccctttccgccttcacacgccccctgccctttcaatgggacttgcgatgctactgattctgtatttattgttttgcatgcgaacttatttgcggcagcttttccggcacggcagcctgttcagaaaagtgtttgcgggagcgctggcagcagccgggatttggtggatactcagtttctctataagtgaactgctgtttctgattatcctggctaccattcagcaaatcggatcatttatttataaacgattctcttatcgcagcaccgcttctcttgatctataaaatagctacatcgcaatcgcagacggacccgcgccaaccggaatcaccgtcacggctgtataatcacttgtgcggtacacggtcacagcattgtcgttgggctgtgccgcataaatatactgtttgtccggcgttacggcgaggtcaaaagcgccggggagagacacgtttgcaatgatcctctgtctggccgtattaactacatataagttattaataagaaacggttcactatatggctctagaaaataagctctagtgctatcgagagaaaatacaatcgtcctcagcgtttcaaataaacggctgaagtcccctcccctgcttaatggagacaaactaatctccgttacacctttcggccacagctcaccattcaacacgtacgcaaaatttccagcgtaaggagttgcaattaaactgggaaattcaaatgtatctatgatactttctaccaactgcccagtatttatatcatatttatcaaccgaccaactgcttccattagcggtatagacatactgtccattcggatcaagagcaaagtctaaagcgccgggtatcggaatgacatcaatgaccgattgagaggccgtgttaatcacatatatagatccggcggccatcacgtatgcgaactcatcttttggatcaaattcgatctttctcggccctcctccaacagtaatggtatttatgatggttaatgttttattatcaatcactgagacaaggttggtatttccatggaggacatacgtgaatgctttatcgaaagtaacgcctagattagttggcacgtcagaaaaagggattgtttttacaacagtgtttaaatctgcatcaataaccgaaaccgtgctgtctccagtattggcagtaaacacatacgattgagggtctggtgatggcggtaaaacaagtgtcccggtcaccgtaagcggactgccgtagaaaggcggtacaatgagcagatcttccactgttatttgactgaaatcaggacagcggccagactgtgctgcataataaacaacttgatcaatctcttcggtatgaatcacagaaaccgccccattgccttgtccatattgatttcgcacaggcgacacactgacaagaagcgtaatggtcccttgtactctcacagcatatcgaacaccgatatcttctggttccggcccagtctggattaagcaaggctcactgatacaggacacattgtctgtactccatgtaacagccgctgacgcttcggccgaatcaaccttgaagccctcagggatatctatcggcacttgaaacggcgcttctcggctaatttcctcatcacaaaaacagaaacaattttcctgtaaagcagaaagatcattctttttcatgatttcacgtccttttagaaatgcacaacatgcagcggttaaatcgtaatggcacccggtgaaaccccaagagatatcacagtttcctcagaataatcatctgtgttgtaaacaatgatgctctgctctataaaacgagttgcatacagaaaatcgccattcggggtaaacgcatagtctgttgctgattgcggaagatttccaattacacctgctccattcggactgacagaatataaattgccagtgaagctgtcatgtaaatacacctctgatccactcgtaaacattacatatagcccgtcaggctccagctcttgggtatccctgatcgtaaacgtatttaaatcaataaccgtcaaataattgaataagaattcttgttctaatacatacgcataccgctccgtagaatctgtttctatggatgatacgataagctctcgttcaatcgttcctaagacttcaccggtagataagtccactttttgcactaacccaaaattaagaacataggcgaacaacccattggggtcaattgcaatatcaaaaccttctacaggaatagacctctcaacagtcaacgtatcaattccaatcacataaatggcagtaccggtgaaaacataagcaaactcatgattagggataaatctaatcaatcgaggcggctgatccagcaatatagttgctgtcactgttaatgtgtcataatcgatgacagaaatcacattattgttgggatgtaagacaaacacagcgcttttatctggcgtaatttcaatacctgccggattgtacggaagagcaatcgttgtcacaacagaatgagtgtttgtatcaatcacagaaactgattgatcatttggattcgctgtaaacgcataaacgggttccggctccggtacaagcacaatcgtccccgtcaccgataaaggactgccgtaaaacggcggaacaacaacaaggttctcaatcgtgatgtcactgatatccgggcaatcatccggttcatcggaataatagacgacttgatcgatttctgcattgtgaatgacggaaacagccccgtccccttgtccatattgatttcgcacaggtgagacactgacgagtagcgtaacggttccctgcaggcgcactgcaaattgaacaccgatctcatcaggctctggccccgtttgaattaagcaacggtcactgacacaagaaaggctgtctgcattccacgtcacgtttgcaacagcttcagccggatcaacgacaaatccttcaggtaattcaatcggcgcttgaaacatggcttctcggcttgcttctccctcacaaaaacataagcactcttcttgttctgctcctgctttttctttaaaggaaagcttgttttttctcattccttcacttccttttcagacatacactgctcacgcagatataacagaatatggaagtgtaacgtgtttgcttgtacaaattgctgagggtaaacgcttctttttgaaaatatatctccaaacatgcggtgtaacgaaagaaaaaattgcggtttttttgcgcttctcacaagaatgttgatgataaaatatgacatatatagaattatgaagggagggatttgcaaacgtgacaggtgtcatatcttcttcttccatcggagaaaagattaacgaatggtatatgtacatacgccgatttagcatacccgatgcagaatatttgcgacgagaaatcaagcaagagctggatcaaatggaagaagatcaagaccttcatttgtactattcactgatggagtttcggcacaacctgatgcttgagtaccttgaaccgttagaaaaaatgagaattgaggaacagccgagactgtctgatctgctgcttgagattgataaaaaacaggctcgtttaactggtctgcttgagtactattttaatttcttcagaggcatgtatgagctggatcgccgtgaatatgtattagccattcaattctttaaaaaagctgagagcaagctggtttttgtgaaagataaaatcgataaagctgaattctttttcaaaatgtcagaagtctattattatatgaaacaaacttatgtctccatggactatgcacgtcaagcattcgaaatatacagtgaacagactacatatgatatcagaatgattcaatgccagtccttattcggagccaactttttggatttaaaacaatacgaaaaagcaattgcccattttcaaaaagcctttacacttgcaaaaacagagcagaagccccaattaatgggaagaacactttataacatagcactctgcaagcaaaaccaaaacagttttgaatcagcgatagagtatgtaaaaaaatctattcaagtatttgaaggatctaaaatgctcccttcactgccacaagcttttttcctaattacacaaatttattttaaattaggtaagattgataacgcctgtgaatatcataaaaaaggaaaagagtattctgcagctgcgggagataccgtgtatctaacggagtttgaatttttggaatctttatacttgtctggaccggatgaggaacggatagaaaaatgttttgtttttcttgaaagtaaaatgatgtatgcagatattgaggacttcgcacttgatgttgctaaatattatcatcaacaggaaaattacaaaaaagcatctcattactttttaaaggttgaagaagcaagacagcacattcaagggggggtgaatttatatgaaatggaagtataaattattactcgcttgtttagctgtgagtgctgtatttatcacagtcgaagtatcaaattcatcaacagaacattttgatgttgcgcaacgcgccatgatctaaaccgccgtccatcggcggtttttttgtcccctctttacccaatctcccaattcatgctgtgatttttttcaataatcttgaagagagtggaaatgcagcatgtctctgtaaagtgtgagaacccactttacacagtggaatcgagaaaatgatgtgacggagttcgaaacgtcgagcgcgacagtgttgaacagacagctgagacgatcggcgtaagcccgactagaatcgccaagaccctgtccttcagaggggaaggagatcaggcgattctgattgtggcagccggcgatgccaagattaataacaaaaagttcaggcaaacatttggctttaaagcaagaatgctctctcctaatgaggtactggagcagacaggccatgaaattggaggtgtttgcccatttgggttggctcatgatcttgaggtttatctagatgtatcgctgaaacggttttagactgttttcctcgcatgcggcagcagaaactccgctattgaggagaattatccgaattttctttctcaaaagcatggattgatgtttgtaaagactaggaataaaaaacatccagacatcgtctggatgtttacttatttcacaaacccaagcagcatttcacggatgattttgctggctgtgtttgccgtttgctctgagtggtcatacaccggtgcgacttccactaaatcagcgccctttacgtttacctctgaacgcgcaatttcatggaccgatgcaagcagttctttagacgtgatgccgccggcgtcaaccgttcctgtacccggtgcgtgtgcagggtctaatacgtcaatgtcaattgtgacataaaccggacggcccgccagcttcggaagcacctctttcagcggttcaagcacctcaaattttgagatgtgcatgccgttttccttcgcccattcaaactcttctttcatgccggaacggattccgaatgaatacacattgtgcggtccgatcaattctgccgccttacggatcggcgtggagtgagaaagcggttctccctcataatcaacacgaagatctgtatgtgcgtcaaaatggataatcgcaaggtctgggtatttcttgtacatcgctttaatgacaggccatgacacgaggtgctccccgcccatacccattgggaacttccctttttctaaaatgctgtccacgtactcttcaatcatatccaggcttcgctgcggatttccgaacggcagcggaatgtcgccggcgtcaaagaagttcaagtcagccagatcgcggtctaaatatgggctgtattcctcaaggccgattgacacctcacggattctgcttggaccaaagcgtgagcccgggcgatagctgactgtccagtccatcggcatgccgtaaagaatggcatccgcctcttcccactcgggacggctcgcgataaatacttttcctgaataagcttcatcaaatctcatcgataataccctcgctttcctgtaaaaaagcgcaagattcgctcctgcgccataccttcattatttaatcaggtcactcacaaatttcggcagaacaaatgccgctttatgaatatcttttgtgtaatatttcgtctcaatatcgaagaaacggctgtcttccactgcaagcggatcatattttttcgagccaattgtaaatgtccacaaaccgctcggatatgtcggaatgttcgccgtatacagcttcgtaatcgggaagatttccttcacgtcgcgctgtacatttgtgattaattccggtgtaaaccatgggttgtccgtctgtgcgacaaaaatgccgtcttctttcagcgctttagcgattcctgcgtagaatccttttgtaaacaggtttacagccggtccgactggttcagtcgaatctaccatgattacgtcatattgattttcagattttgcaatgtgcataaatccgtcatctacctgcacgtcaacgcgcggatcatccagtttgcctgcgatagaaggaaggaactttttagagtattcgatcaccttgccgtcaatatctacaagtgtcgcttttttcacgcttgggtgcttcaggatttctctgataacgccgccgtcaccaccgccgactacgagaacgtgctccggatttgggtgcgtgaataatgggacatgcgccaccatttcgtgataaacgaattcgtctttttcagatgtcatcaccatgccgtctaaaaacagcatgttgccgaactcttctgtttccaccatttctaaatgctgaaactccgtttgttctgtatgtaacgttttgttaaccttcatcgtaatgccaaagtttttcgtctgcttctctgtgtaccaaagttcgctcaattgtcatctccctttcgaggctgtattcatttattgtaagcgtcttatcagcttttattctcggttgaaatctcattttcacctaaggaaaaagtatagaggatgccggggaaaaagtaaagatgcgtcctgttctgcgatgtttaaaaacgatctttttttctcataatagtagaaacataaaaaaaggggggaacccgttgtggatgcaatgacaaataaacggctgagactgacgctgaaaaccgttcgcgcctttatctttttaggggcttttgcggccttggcggcagctgccgtgtttatgactgtcattttgatagccaaataccagggcgctccctcggtgcaagtgccgcaatccacgattttgtatgcgagtgacggctcaaagctcggggaaacgaactacggcgaaaagcgctattgggtccccttaaaggacatgaatccgacgatcgtaaaagcgacagtggcgattgaagaccagaatttctacgatcatcacggctttgattataaacgcatggccggcgcggcgcttgctgacctgaaagcatttgccaaggttcagggtgcaagcaccatcacccagcaatatgcgagaaacttataccttgaacacgacaaaacgtggaaacggaaatggaatgaggcgttctacacgatccgtctggaacaaaactattctaaggacgagatattagaaggctatttaaatacgatttactacggacacggcgcctacggcattgaagcagcttcccgcctatatttcggcaagcatgccaaaaacctaaccgatgcggaggcggcgcttttggcaggtatcccgaaaggcccttccggctattcaccgtatgtcaatgagacgaaggccaaggaacgccagaaaacgattgtgcggatgatggaaaagcagcagatgatcagccaaaagaaagcggatgaattgatcaaggaacctctttcctatcagcctttgaataagcaagtttccaagagaaaggctccttatttctacgacaatgcgatgagagagctggagaaaaagctcggcatgacacgggagcaaattgaaacgagcgggttaaacgtctatacaacggtagataaacggatgcagcgcatcgccgaggagaccattaccgaaacggttaacgcgggctctgacattcaagtcgggttttcagccattgatccccgcaccggaaacgttctcgcccttgtcggcggcaggaattatcaaaaaagcccgtttgaccggacgacacaggcgaagcgccagcctgcttcgacgatcaagccgttgctgtactataaagcgattcagagtggatttacgccagtcactttaatgaaaagcgaagaaaccgagtttcaaattgatgcaaagggagaaacctattctccaagcaactataacggatactacgccaacaagccgattacgcttctgcaggcgctggcgctttccgacaatatttacgctgtgaaaacgcatctttttctcggcacgaacaaacttgtaaagacggcaaaggaattcggcattaccgcccatcttcaagcactgccgtctctggcactcggcaccgaacccgtgcgtccgattgagatggtcaacgcctatgccatgctcgcaaatggcggaaagaaaatcgaaccgacttttatttcaagggtaacggacgcagccggccacgtgctgtacgaaaacccgaatcagcataaacaggtgcttgatgaaaaagccgcttttgtcacagcgagtatgatgacaggcatgtttgataccgatttaaatggatatacgtcggttacgggacgaacgatagccaaccgcctgacaagaacgtatgccggaaaatcaggaaccaccagcgcagacagctggatgatcggcttcaatccgaagctggccgcaggtgtttggaccggctatgacaaaaacagcaccatcgactcggtcgaagaaaaaagctatgctaaaaccatttgggcggacttcatggaggacgcgctcaaaggcgaaccggaaaccgcgttcaagccgccaaaaggcgtaaccggtgtgtacattgatccggaaacaggctactcatcaggtcccggctgtgccgctaagcattacacatattttgtgaaagggacagaacccgcaaacgtgtgctacggggcagaacccgcaaaacaaacaaaagaccggcttccatccaaagaaaagcccgcttccgagaaaaagtggtgggacaaatggctggggcgacatcattgaaaataacccggctcctcggaggccgggttattcgtatggttccttcataatcgatggaagaatgttagacaatcgagctgaacaatcagttttgggataaagtggtgaatttctcatttcttcggcgctggctttcatctcccagtcgccgactcatatccccctaaaaatgaaaaaccccgagtcttgtttcggctcgggattttccatgtcctatttctgtatcaccagtttactcaatgtttacgaaaaatatctcaaatactttaaaagttcacagaaaattcataaattaattgttttccggaagcaggcttgtttttaattcatctgatgaacggtcccataggccctgatcatgctttttcagaaattcgcctagtacacgcttcgagctgtcgtccattttatcaacgatgattttccgtttcatggatttatccatcaaattcacatgctcaggcagcgacttgtagcctcttctgatgcttctgtcgaccgtcatttcacaggctgtcacaccagcgtaataaggcccctcttcttttctgtcaatcgttacccacacaagccagtatggttttccgttcggcacttcttctttattcgggagaaatttaattcctttttcaacggtgctgcgggcatgcatggcgccgatgtctacgaacgcttctttttcttctacatcaacgaatacgggagaaatgttatcaaggctgagtgcccctacgccaaaaccgccgtgtccgtctgtcggatcacttttgataatattaaacccgattgattttttctttttttcttccatgaagttctacctcctacaaaagcggttgaaatatcgctgaaaacagctttaaaatcgaatctcttcctgcattgagcatcggccacagcacgtaagatcctagcggtgtcacaaacagcaccaaaaatacgataaagccgtagctctccgcctgcgtcattttggtacgcatgcccggcggaacgagatcttctataattcgatagccatcgagcggaggaagcggcagcagattaaataaaaacaagacaagattcagctgtatccaaatggaaaaaaactgatccagccccgtgctgaacgccgcaagcatttccattccgtacgcatgcatcaacactaacaaaaagaaaccgataaacgcaagaatcaggttactgacgggcccggctatagatacgagcacaccggcaagccggggtttcttaaagaagcggcgattcacgggaatggggcgcgcccacccgaagccggccaccaaaatcaaaatggttccgaacggatcaaggtgtttaatgggattcagcgtcagtcttccttgttttttcgccgtatcgtcaccgaatttgtatgcgacataagcgtgggcaagctcgtgcatcgtaaacgacacaattagcgtgatgacgaggtatggcattaaagataacggataatataaaaaacggtccaagtgagatatccctctttctcaaaatgcaagaatttactttattcagtatactataagaagcctctttttctaaagagaggaaacgagataaaggaggattcagcacccatgccatacgtaactgtcaaaatgctcgaaggccgtacagacgagcaaaaacgcaatcttgtcgagaaagtaacagaagccgtaaaggaaacaaccggtgcttctgaagaaaaaattgttgtctttatagaagaaatgagaaaagaccattatgccgtcgcaggcaaacgcctgagcgatatggaataatctctataaagccggcgcttcgcgcaccggcttttattatccctattgagccagcttcgcaataatcgccaagaacgtctttttctcttcggctgttaaacgttcaaacatgccatcaatcagctgctggcggttttcgatcatttgttcagccgctccccggcccgcttcagaaagcgtaatccatacagtgcggcggtcattgttatttctcgatctctcaataaacccttcctgctctaaatgattcagagctgtggtcgtggcagagggagacagtgtgacctccttcaaaatatcctttatggtgcagctcccatgtctgtatatgatccgcagaataaatcctcttacattattcacgtgtttcggaacggtggcttcatctaattgcttcgtgcttttcaaatattttgtaagtgcgtgatccagcaaatttgcttccagtttgtcatggtccatgtcaatttccccatttcgagatgcattcataacatacgaacgatatgatttacttattattttactgattccgaatagggaaagtcaaaaaagcaaaatgtgaattcacagcttttatcctacatgcctcgattttccacctgtttgacaagcttatctttaaatgtctgaaaaggaacatgttcattctgctgatgtccgaatcggcggacgtttaccgcattctcctgctcctcatgatctccaagcaccagcacgtacgggattttctgcacctgcgattctctgattttatagccgagcttctcattgcgctcatcaatgccggctcttatccctgcctgcttcagctccgcctgcacctttctgcaatagtctaagtgaacgtgcgaaaccggtatgatttgaacctggagcggtgcgagccagactgggaaagccccgccgtaatgctcgatcaaaataccgaagaaacggtcgatcgagccgaaaaccgctctgtggatgacaacgggacgaaccttttcattgtgttcgttgatatatgttaaatcaaatttttccggcatttgaaaatcaagctgaattgtcgcacattggtggctccgtttcagggcatcttttatgtggaaatcaattttcggcccgtaaaacgccccatcaccttcattgatctcataagagaggccaagctcctcaaggacgcgtgctaaggcacgttccgacgcttcccaaaggctgtcatcgcctaatgaatcctccgggcgagtcgaaagctcaactgaatactcgaaaccaaatgtccgatatacctcatcaatcagccgaatcgcttctttgatctcactctcaatctgatcctcccgaacgaaaatatgggcgtcatcctgacagaacgtccgaacgcgaagcattccgtttaaagcgccgctgtattcatggcgatgcacctgtccgaattccgccatgcgaatcggcagatcccgataagaatacaggctgtttttaaagatgagcatgtggccggggcaattcatcggcttcattgcgaatcttgtatcatccacttctgaaaagtacatattgtcgcgataatggtcccaatggcctgactgctcccataaccgctgattcatcataaacggcgtacgcacctcatcgtagccggcatttgtttgcagctcacgcgagaagcgctccagctcattgcggacaatctgccctttcggcaaataaaacggcatccccggcgcttcttcagaaaacataaacagccctaactgtttgccgagcttgcgatggtctcgttttgccgcttcttccagcatatgcaggtgcgcatccaaatcttttttcttttgaaacgcaaccccgtacacccgctgcaggacttcatttttactgtctccgcgccaataagcgcctgatactcttgtcagtttgaacgccttgatcatccctgtagaaggaagatgcggcccgcggcacaggtcaacgaattccccttgctggtacagtgtgatatcctccccgcgcggaatatcctttaaaatctcaagcttgagccgctcgtctttttgtgcaaacagctcttcagcttcttcgtaagaaacctctatacgtttgatttcaaggttctcatttattatgtttttcatttctttttcgatggcccctaagtctcctgatgccaagcttttccccagcttcatgtcatagtagaagccgtctagaatcacaggccctacccccaatgacacttcgccgtacagccgttttactgcttgggccagcacgtgcgctgttgtgtggcgaagcacctgcaagccttcttgtgaatcgagtgtgacaatcgaaagctcagcatcctcctccagcttgaaactgagatcaacaagcttgccgttgacctgacctgcggccgccttcttttgcagactggaactgatagaaccagccgcttctttgattgtgatgcctttcggatattcctggatctgtccgtccggaagctgaatgtgtacatttttactcattttaaaacactccttattcattgttgtatataaaaaaacacacccgtcccgcagatagggacgagtgtgtgattaacccgtggttccacccaagttcccgacaaatactatattgtcggctcggtgctgtaacgcagcatagacggcattggatacttcagttccccaatgctgctccaaggcggtaaatgatattcctaagctgggaagctctcacctttccttccctctctgaaaaccgtaactatcattcgtgtccttttcaacgcatttatgtagttcatataaaaaaacacacccatccctctaaaagggacgaatgtgttgatcatccgtggttccacccaaattcccgatcaattacacatggtgatcggcttaaagatgctgtaacgcagcatgacggtatcagatacttgttttccccgatacggctcaaaggcggtaagctgctttccctgcgttaggaagatctcagctgtccttccctctctggaaaccgtaaaaagcatctcgtgtccttatcagtgcctgttgtttcaataattttttacatcttactatatattcccacaaagtgcaatcagtgatttacattttttctgacgcggcagtcccgttatgggcagccagaaacagccatacaagcaatgcagcgaggctgtatgcagcccccatcatcaaaaatgtaaacccggcaccggcataccaagtggcggacagatgaatgatcaccccggttatcgctacgccgaccaaggctccgatttgccggtttgcatttaacgccgcaccggcgatattcgcatgtctttgcccggcagcctgcatgatcacagttgtcatggcaggaactgtaataccggtacagaggttcataacagacatcaacaccgccagctgccaataaggaaaatccggagaaatcagcacaaacaacagcaatgcaatgatacagctgaccgccattgatacaaacataagctgcccggcttcaaatcgattcgccagacgggcaaacagcagattgccgaacacgaagaccgccatcatcggcagcagctccactccagccataaaggaacttgcccctcctgcttcctgcaaaaaaaggctgagcataaacatgccgccaaaaagggcgaaattcagcaaaaacccgataaattgggcagctgagaagcggccgtttttgtataaggacgccggcaggatgggtgcttttgcagaaatttcccgcagcaaaaacagcacaaatgccaaaatcgctgcagtaaatactacaagaatcactggcgagcgccagcccgctgaaggcccctgtatcaaagcataggaaagaaacccgagagccatcatgccaagcagatgcccgatgatgttcacgcggctgctttttcccggaacgcggctgaggattcggtaagctgaaatgagcgcagcagcccctattggcacattgatcagaaaaatactctgccagcccgccaactctaccagcacgcccccgataaaaggcccaagggctgaagcggcagaaacaagcgcggcccacagcccaaacattctcgcccgcgcccgctcatcagggtaagaggcagccaaaaggctgagtgagcttggcataaacaaagctgcgccaattccctgtataaggcgtccggcaatcagcatctgtccatttatagatgcagcgcataaacaggaggccagaacaaaaacggctagacccaagatatagatcgtcttcgagccgaaacggtcagccaaggctccgcccgccagcagaagcgacgcaaaagtaagaatgtacccgtccacaacccacgttacacctgaaagtgacattgaaagagtgtttttcatatcagccatcgccacattcacaacggtcacatcaagagttgccatgaggaaaccaagtgcgagcacgatcagcacggatatgcctgttgatgatgttgattcttgtatagacccactatttttcattacaattgccctttcacttgcttgattacccaatcatctattttttcaagatcatacaattccccgactctgtccatgacatgctgcaaggattcttctctcataagattggaccatttatcctcgatttcccccatgactgtctccagcacacagtgactttcaccctcaaatacagattgcagcaggcctttcccctgatacatcgaacctctgccttcgaccgcttgataaacatcataaagcgtaatgtcagccaaaggcttcgtcagggtaaaaccgcccttcgtccctggcaaggattctgccaaaccggcttgaactaatgttctcatcagcttcttcaagtaagacggagacacgcgcaatcgctggcttatagcctctgacgtcaaagaagcctgtacaggcagccttgacagtaacagcagcacagaaaccgcctgctccattcctgatttcattttcatcctattcactcccgattcattatggataactattatccataatgaatctcttagcagcttttgtcaataaaaaaagcaaaagaaacgattcatttcttttgcttagtatggttaacaaatctgcttcagttcctctatgtattgaagcgcttcgtcatattcttcatttgtatatttttgcttgcttttgatggtaaagactttttctttcttttcctcatcctcaagcccgtcaaagtaaaggatcgtggaaaccagctctaaaaaccgtgatgaacggctgtttacactgtcgatatagcctttcatatccggcatgtccagatcagcatggtctaaaaatgcggagcctgtctcagtcagcgaataccggtattgaaagtagccgccctttttttccttcacctcatgcagaaatccaaggttgcacagctcttcaatctggagcgtcagttcctccgaatacggtccataaaagtgaaaatcatatttctcatagaaaggaaactgcattttcttggcgatataaatcattttctgcagcttctttcgcccgatgatttctccagaatccgagaacaccttcatcagttttgcatgttctttcaacaaattcccgacatctcctttttccttctttccaatttctatgtcagtcccagcagctgccggattttcattttcgcttccggatgttcagagccgtcacaaatcaagtcctttggatagtacagcttgtggtccgtccgccgtttacctgagatggattccacaatagccgactgcctggacagctctttaatttggccgttttgcgtcaagagatggatcggcagacgctcctcttcctctcccggtcggtaaaaatcgtatggcagatctgatgaagaatcaacgaccaaataatagctcggatcgattcccgcctctttgaacaatgaagtcagctcaaaataagccgacatttcttcattcggattgaattcaacgtattggaacagctggcggttaatgaatctgcggcacaagtcggataaaatcgcgtcttcttcatcctcccaggcctggaagtaatacaaaataatagattcatccagctttacataatcctccagtgtcaatttcccttcaaaaatagaatagaaatgaaccggagcgtgagtgaagacatagccttcatcgtgcagctgcttcgccctgtgaagaatcttcgttaaaatgacctctgcacttctggtcacaggatggaagtagacctgccagtacatttggtaacggctcatgatatagtcttcgacagcgtgcattccgctttctttaatgacgatctgatcctcgcgcggccgcatcacccgaagaatccgctccatatcaaaatggccgtagctgacgcccgtataatatgcgtcgcgctgcaggtaatccatgcggtctgcgtcaatctgactcgaaatcaggctgaccacttgcttgtttttatatgttttggcaatgacttcagcaacatcctgagggaaacccgggctcacctttctgagcacctgattaacctccgtgtctcccaaaatgatacctcttgtaaaatcctcgtggtcaaggtgaaagaccttttcaaatgaatgcgagaacggcccgtgcccgaggtcatgaagcagcgccgcggccaaacagagttcgcgctcactgtcatcccattcagggcggcctttaaagacgtcatcaaccattcttctgacaatttcatagacaccgagagaatggttgaaccggctgtgctcagccccatggaacgtcaaataggtcgttccgagctgcttaattctgcggagacgctgaaattcacgggttccgatcaaatcccatatcagcttgtcccgaacatgaacatagcggtgcaccggatctttaaacactttttcttctgataattttccatttggatacgccatcgtcattccctcttttttttagccgtgtttctattatatcgactctattctttgaaaacatccttgaatttgcccggcgatttgttccatcttcatgaaaaacacatcttgtgaagcaaaaaagcctgacctgagggccgaggctaagaaaaaatatgtttttacttttttattttcttttttactttgtcaatcagctcatcctctgtcggagctgacagcgggcgattgttcacaaaagcaaatgattttttccgtccgggcccgcaataagattggcatcctacctcaacctttgcgtccgggtccacttctttcaaacgcggcagcaatgttttgatattagtggcttggcaatcatcacacactcgaaattcattagccatgacgtacgcttcccttcatttctatgttcatctatgtgaataacctaaaatcacgtttcaaaaaaaatcacatcactcttcattttacaaggattcgactgttcctgcaagccgctccatccttcgtatctcctattctttcagccaatttgtataaatattttccaacctggacattctaataccatgaaaagaaaaatgggagttgagataaatgacaaaacagcgacaagacgcttggtcagaggaaaacgatctgcttttagccgaaacagtgcttcggcatgtgagggagggcagcactcagctgaacgcctttgaagaagtcggcgataaattaaaccggacatccgcagcctgcggattcagatggaacgcagtggtccgccatcaatatgaaaaagcgcttcagcttgcgaagaaacaacgaaaacagcggatgagagcgctcggaaacgggcagcccgcgaaaaaaagattattatatcagcctcctgccgttgatcctgaaatcattcaagaaaccgctgcagaagagccggttaaaacggaaacaccttctgtcgaaaatgagcaacctttaatgtctggcgaacatatgccttttgttgatgaaagctttaaggaagagttagctagtctatcacacttattgtctcctcaaacgcctgcagctgcgcctgagatgacgatgaatgatgtgatccgcttcctgcagaattacaaaggcaataacgagcaatcatcagcattaaaaatggaaaacgagcgtttaaagaaagaaaatcaggaattgcaaaacaaaacagagcagctagaggcagaagttcaaaagcttgaaaaagaccaaaaaacgatccaagaagattatgaaaccttggtgaaaattatgaacagagccagaaagctagttttatttgaagaagatgaacatgcctctccgtccttcaaaatggaccggaacggcaatttagaaaaattagcggaatgacatagaaaaatcccaaaacgggcagctgttttgggattttcgccatgtgcaaaatccccttttctattgagaaaagagaatttcctcattttgcagccggatcagctattcttgtaaaatgaggccaagcttatgtgaatctattaagacatgtgagctgcctcggccgttttttgtttccgaggcgcagcagaaatgaccaaaagccccagcatcataagcgcaatgcccagccacgaggaaggcgaaagcatttcccctatgaaaaacacgccaagcaatgaagccgtcagcggttcagctaaagacagcgtgaccgccgccgaggccggaaccccggtaagccctttcgcaaacaaaaagtatgcggcacatgttgcaattaacccgatgtaaaggcttgttcccagtcctctaggggtcaatatccacgagatatctaactgccataatagcggcgtcagcaagatggcgctgatcatgaatacaacggcggaggtcgctcgcggaggctgggttttcatcatcgctttactgatgagcgtatagcctgcaaaagaagcacccgctccaagcgccataagaacaccagccacatcaatccgaacattggaactgtcggaaaacagaagccagcaacccgctaaagccagcacagtcgcaatccaccaagagtttcgcgggcgtttcttcaatacagcccattcgagggtcccggcaatgataggcgcactgccgatggcaatcacagttcccactgcaattcccgtttctttaaccgctgtgaaaaacagcggctggtaacacgccatacaaacagcggctaaaaatacgagcggccatgaccaatttttcacgtgaagctcccggctgatccaaaccgcaagcagcatggcgcttcctcctattaataacctgaacgctccaaatgccagcggtgtggcgctttctggagccaacgcctgaacggttcccgtagttccccagaaaaaagccgccatcaatacaaaaaggctgtaaatattccccttcatctgcctctcccctttaatatggatgctgatgtcattttatcgtttttctttttgtcgtggttatctgtatgtaagaaggatttatctgaaaataagattgtggggtaaaatgctgcttgaaataaaaaatgtatgccggcatatacagccggcatgcgaagaacgttcacccaaatacctttgcattccgctcagccatccggacgaggtttttctcaaattccatttcctcatcaatggacagtccagctgaataaagatgggtgcttaacgcttttaattccgtcaataaagcgaacattaagtcttgtacggagatgtctttttgcagaagctcacttaaggacgccatcgtttccggacgtatttccggatagacgccttttttatcgttttgcttgtctttcagcgccgcttgatagaatcgtctgatcaagtcggccctttcactgccgcttttatctgcacagagataaatttgaacagcgactccgccgcgaacgcgtctctgagagatgccggcgaactttttgccatttatactgaggtcatagctgccgggacaataagacccttcaatttcataggcttcgatctttgcgttgtacggtctcagcattcgtctcatcagctcgaccatcgcttcatatcctttgtctatatcgatgcctttcttttcgtcctcgaatatgagagagatatttaaaacaccgtcatccaatacgacggcaagaccgccggaattgcgtacgatcacacggtatccttcgctctccagcaaggagataccatcctgcaaaaacgggaggcgtgtatcctgtattccaaggacaattgtatcgtggtgcacccatgagcgcgctgtcgccggcgacacgccttttccgacggacatgcatagcgtatcatccattgcgaaggattgcttcgcatcaaataaagggccgagactggattggtcaatgactctccatttcggctgcatcagtaaatcaatcggttggtttgccatctatgtaaaaccctttcatgttaggcttattgaacgaaaactattatatcatttcagcagctgtgattgataattgcttttcagcatcgtaataaaaatttctttattttttgtattctccatgagaggagaatgaatgtaagacagcttgcgctttaacgagaaattattaatatgcagaattgaaatttcgcggtggatcaaatccttacgcagcacgcttctggatagaaccgaaagtcccatgccgttaatcaccgcttcctttacaccttgattgctgctgatggtaaacattgatttcggccgaagtccatttgaactgagtacatgatcgagatattctctcgtcccggagcctttctctcttgtcacccacgcttcgttctgcaaatcgctgatcgaaatctctttccgcccggcgagcggatgctgatttggagcggcaatgcacatttcatcctccatgaacggttcaatttccagctcattctcgtttgtatgtccttcaatcagcccgatatcagcctgaagcatacgcacacgctcgctgacctcctctgtattgccaatcatgacatcgaggttcagctctggatacagcttttgcagctgggccaatagcggcggaagaatatactcaccaattgtaaagcttgcagctattttcaattcgcccttcacatagtgatgatgcgcatagatttcagccttggcttgttcgtagagaaacaccatttgctttgctctttgatataaaatgtctcctgtcggcgttgtcgtaaagtgttttggcgacctgttcagaagagccgtttgaaattctttctcaagatttttgatatgcagactgacgctgggctgggagatcatcagcttttctgccgcttttgtgaagtttttttcttctaccaccgctataaacgttttcagcacgtcgtaatacaaaaaccccacccctgtcattaatgaaatatatggttatgattagttttctttattgtactcatatcatccgtcttggtaaagaaggctatacagaagcgcaaaaaaggcagccctcggtcgagagctgccatcgtcttcatttttattacagtgcttgcgccgctgtaattaatgcgagattgtaaacatcttcagcgttacatcctcttgaaaggtcgtttacaggcatatttaaaccttgcaggattggtcctacagcttcaaagttgcccaaacgctgagcgattttatagccgatgtttcctgcttcaaggcttgggaatacgaatacgttagcgtcccctttgatctcggaatccggcgcttttttctcagctacagatggaacaaatgcagcatcgaattggaattcgccgtcaagtgtcagttcaggcgctttttctttcgcgattttcactgcatccgctactttttctgtttcatcagattttgctgagccttttgtagagaagctgagcattgccacgcgaggctcaatgtcgaacatttttgccgtattggcactttcgatcgcaatctcggcaaggtcttggctgtcaggcgcaatgttgatcgcgcaatctgcgaatacgtattgctcttccccgcgagccatgatgaacacgcctgaagtctttttcacgccttcttttgttttgatgatttgaagagccgggcgtacagtgtcagctgtcgagtgagcagctccgcttacaagtccgtctgcaaggcctttatacaccagcattgtaccgaagtagttctcgtctaataacgctttgcgagcctgttcttctgtcgctttgcctttgcggcgttctacaaatgcttgtacaaggtcttccatgccttcatatgtatgaggatcataaatcttaacgccgtccagcgtaaggttcaattcttttgcttttgcttggatctcattttcattgccgatcacaatcggattcagcactttgtttcctgcaagcttgctgaccgcttctaaaatacgctcgtctaagccttcaggaaatacaattttaacgtcttttccagctactttttcttgcactgttgaaaataaatctgccacaataaaacctcctcaaaaagttacaaaaacgctttcttttactagcatactcttcttccaatcaaattcaaacagccaactttcattatagcgctttcataaaaaaatcttatttttctaactaatttaagtgactcaatcttcccttataggttcttctattttgatggagttatacggaagggatgttcaaggtttctccacagtagaatcggataaactatggtatagtgaaggcaatcatgaaaagataatgggagtgaagataaatgagtgaacagcaaatgacgaatgaagctgcaaaaacgcttgacggctggtatgcgcttcatgatttccgcacaatggattggacttcctggaagctgctgtccagtgatgagcgccaatctatcatacatgaattcaccgggttgcttgaaaaatggggcgtagcccaaaaagaaggaaaaggatcgcaaactctttacagcatcgtcggccaaaaagctgattttatgctgatgatccttcgtcctacaatggaagaattaaatcaaattgagcttgaattcaacaaatcaagacttgctgagttcaccattccggcatactcctacgtatcagtggtagagctgagcaactacttggcaagcggtgacggcgatccttatgaaaatccgcatgtgcgcgctcgcctttaccctgaactgccggaatcaaaatatgtatgcttctatccaatggataaaagaagatccggcaatgacaactggtatatgctttcaatggaagaacgcagaaacttgatgagaagccacggtttaatcggccgcagctatgcgggcaaagtcaaacagatcatcaccggctctgtcggctttgacgattacgagtggggcgttacattatttagcgatgatgtccttcaattcaagaagctagtgtacgaaatgcgttttgacgaagtcagcgctcgctatggcgaatttggttcattctttgtcggcaatcacctttcgcttgatacacttcctcaattcctatatgtataatatcccctcccgccctatccggcgggagtttttcaatcctcctttatcagaatttaaataaaatttgctattttcttcgttttttcttacgatgtagataataatccaattttttcaaaggggtgcagttatttgtcaaaacgaaccgcatttgttatgggagccagtcaagggatcgggaaagcaatcgctctgaaattagcagaccagcatttttccctcgtcattaattcgcgaaatttggataatattgaatctgtcaaagaagacattttggccaagcatcctgaggcgagcgtcattgtccttgcgggcgatatgtctgaccagcatacgagagcgggcatttttcaggaaatcgaatctcaatgcggacggcttgatgttctgattaataatatcccgggcggcgcgcctgatacatttgataactgcaatatagacgatatgacggccacgttcactcaaaagaccgttgcctatattgacgctatcaagcgtgcttcctcactgatgaaacaaaacgagtttggcagaatcatcaacattgtcggaaatctatggaaagaacccggcgccaacatgttcacaaacagtatgatgaatgccgctttaattaacgccagtaaaaatatttccatccagcttgctcctcacaacattactgtcaactgtctgaatcctggttttatcgctacagaccgttatcatcaatttgtggaaaatgtgatgaaaaagaacagcatatccaaacagaaagcagaggaacagattgcttccgggattccgatgaaacgggtcggatcagccgaagaaaccgcagcgctcgccgcgtttcttgcctctgaggaagcctcctacatcacgggacagcaaatttccgctgatggcggcagcatgaaaagcatataaaaacatcccgctttttagcgggatgtttcttgtaatgacccgaacggcaggttcagcttttgaatccgcgtgacaaattcccgcagatcctcctgcttcgacaccattgagattctgacatgcctttttccgttgcttccaaaaatttcgcccggtgtgactacgacatgggcatgctccagcaagtaatcggaaaattggtgagatgtctcaaacgtattcggaatttcagcccatacgtaaaaggttccttttggcttttccatcttccagcccaattccttttcgcaaagcgccgtaaaaaagtcaattcgttccttataaattcgtttcaacgattccgtatgctccggatctccagaaagcgccgcactcgctgcctgctgcagcccgccgaacatgccgacaaatacatgatcctgaaattcattgacggcctgaatgatcttttcgttcccaaccgcaaacgccattctccagccggccatgttaaatgtttttgaaaatgaataaagctctgctccgacaattttggcatcctctgcctcaagaaaactggccggtttttgatcgaattcaaacgctccgtatgcaaaatcatgaatcaaatggatgttatgctctttcgcaaaagcagcagctcttgcataaaaagccgcatcagccacagctccagtggggttgttcgggtagtttaaaaacataagcttcgctttttccagcacggctggatcaatcttttcaaaatccggcagatagccattttcttcatacagcggcatttcgtaaagctcagctcgcgccatcgtaatccctgataaatattcaggatagcctggattcgggactaaagcgatgtctcccggattgagcaggcattgtgtcagcacatacaatccggctttcccgcctccgaaaagcgcgacttccgtttcaggattgattgtcactccgtattcccttttatagaaagcagcgatcgcttcctttaaaaaaggatagcccctgaaagggccgtatccatgaaacgaaggattcagagaagcctcccgcaaagcctccacaatatgcggcggagtgggaaggtcagggttcccctgtccgagattaatgatatgggcccccgttttttccaattcctttaccttttgaaaaacgagagaaaactcctgccttggaagtgtcttgatgacatcggacggtgttatttccatctaaaagactcctttttgctccgttttgttatcccgttccaaaaacgatttgttgacgagcttcgtatgcagaaacaaaccgcatacgatcacgacaatcagccccataatgaccggagcgcttaggatgttaatgaacattgaaccaatagaaatgcataatccgatagacgcttcggccactgaaaaaatgcgcccttgaatctggtttgccgcattttcctgaaccttcacttttgcaagcacttccccgtattccatcgcgatgaaaaagaggatcgccgcgatgacagaaacagcgaaaatcggcgtgaataaaaacagcgccagtgagacaatggataaaacggtaaagtacgtcaggcctctattgttgttaaagccccatttgctgacaagcaccgctccgataaagccgccgaagccgatgcagaacgtgagaataaagttgccgatttccccgtcacccagaaagcggctgacaatcggaaaatagctgtacacaactccccacagcaaagccattgtaatcatcgtaaacatggcgtttaatacgaatgcattggttttgatttccttgagtccttccttaaaagactgaaaggcctctttaatgttttcagattgaatcggcacaaattgcagcttgatacggctgataaaaaatgccgaaaccaggtatgtcaaaccgttaaaggcaacagccagctctacagatccacctaacagaaagagccctccggcagccgccccgacgataatggagatggttgtcgcttttgcaaataacgtgttgatgcttttaatatctgattccaaggacgacatgacagcgagacgggcgggattaaaaaacacgccgcttccataagaaataaacagcagggccagaaaaatcagcggatactcgccttttggaagaaatgtgagccccaaaaagatgatgcctctgatgatatccgtccacagcatgatcttaattctgtctaaccggtcgaccagaacccccaaaaacggctgaaacaccatcggaatgcttctgaccacgatgaccccggacgtcacccaataatcgtgataatatgtagacaaaatgagcagggcagggagaacacaatagtctcccatgaacgatagcgcctgcccgtaaagcaagtatttagagttgggtttcagctgtttcatactggcagcacatactttgccgtcagctttgcatgctgctgaatttgtctgattgattcagccacatcctgtgaattactgcctttcagttcaaatgcagcaatggaattgaaagcttcaaacaatgtcaaatcaattgaagtgcctggtgctgcggccgaaaaagaaacgatttcagtatccccttttaaaagcccgtccggaatatcgatcgcttcaatgaccaaatcctcagcggtttctggaatctggccattttgtttgaaatgctgcgggtacaaatggcagtcggcgacatagtaaggctcttgatccaataatccgtccggcagatcggcatcttttccgaaacagaggacatctaataataattgcgccatatcaaggccgaaaacctttttaatgttagggatcatattccagccggcaaatctggctgccgattcaattaaacccggttctctgtttttcattagcttgacctctgtatgtgttgcgcaattttgcaggccaagcccttcatttgcctttttggcagcttcgacaattttcttttttgcctcttcatccagaatggacggcgtaatgtgggatgtctctgtaaacccgatttgcggcgttttatcatgaatggcgatcgggaaatactcaccgtcagccatgatgccttctatactgatatagtcggagtacccttctgtttgataccagtctccgtactcaccctgtaaaaattcttcagcgataaacggcgcttcaaacgtaaccgcctttggcacgttaattgatttcagatagtcattgactctgttaaattcatcttctgccgtctcagtgtccgtaatcagcgttacaccgatagaactcgctaagtatgtaggctttaagataagaggtgtgccgatctcttcaagagcagcacggaaatcttcaagagttgtgactcgtttgtttttgatcgatttgactccggccttattaaaagcgtccctcattttatttttatctctggcattttcggctgcctgcacgccggcacctctcaagcccagacgttcacaggctttcgccatcggagcaatgaataattcattgtttgttgtgatggcatccgccccaaacatttcggcaaccttgacgatttgctcgacgacctcttcctcaggcttgttatgatcctcatgcgcccaataaatggagtcaggatgctcaaaatcagctaaactcttaaaatagtctttatcttttacgaccgcgaccgagtatttttcaatcaatgctgcatgggaggctgtaattgcaaaaggtcttggaataaagctgaccaggttatatttttcagcagcgcttttataaaacatgtgcggcgggcagcctccaagatcagcgatgaccaatactgtttttctctccatatgtaaaacactccttctctattgtgcggtgtatcctccgtctgcggtgatggcgcttccggtcatatagcttgataaatccgaggctaaaaacagcatcacgtttgcgatttcttcaggtttcccaagcctcagcagcggatttaccttcgccttttcttttttgatctcttcaagtgtgccttcattattttcaaggaatgatttttcattcagcggtgtgtcgatgatccccgggcatacgcagttcacgcgaatgtgatgcttcgcataatcaacggccattgatttagtcagctgcaaaaccccgcctttgctggcgttataagcaggaatatcaggccatgccacgagtccgccgacagagcacgtattaatgatgttgcccttgccggcggccagcatatgcttgagtgcatgtttgctcattaaaaacatgccggtcaaattgacttgcagcaccttgttccaatcgctgagctccatctcgtgaataggcgccacgatttcgatgcctgcattattaatcaagacatcgagcccgccaaatgtatgaaccgccgattcaactgcgtgctggcaggcagcttcgtctgtgatgtccgtttgcacaaagtgcagcctgtcattattttcttttcgtaccattgcttctccctgcgcttcatcaatatccgccacaaccacattggcctgctggcccaaaaaagcctgaaccgcagcataaccaatgcctgatgcgcctccagttataaggacggttttatcggtgaggttcatgatcattcatccgccttcattttttttgcttttgctctgttgtagcgcggcgggaagaagatattaatcgattttgattctttttccgaacggttgatggcaccgtgatcttcacgaggctcacagaaataggctgtgccgaatttcatctcgactgtgcagccttcgaccgtcatgtcatagccgccgccgatgcagatgcctatttgttcattccgatgtttatggaaaggcatttctccgccatttccagggattttggcaagcataatttctacccaatcctcaacaaagaacgtgacttccatgcccggcagcaggtctcttgttttgaaaatatccaaaaagtagtcctcaggacttgtatatgtttcatcagctttcagccgcttgatatcaatagcaatcacttcttggtctgtgtcgtttcttgccccatgtggcacatgcggcggcgcgatataggcagattccaaggctgtcatttttcttgtcacatctccgacagtcatcatcagctcgccagaaacgaccatgccgatttggacctccttatgctgatggggttcaacattggtatgcggcgggacgtaagacattaatacttcagtatcccctcgtacggttgaatactgcctcactccgttttcccattcaattaatttcggtgtcgggaaataaagctcctgcatatcttctttagttttcatcatcaacgtctccttttccaaataatgaccagctcattggaatgcttttgaatgtttttacaaaggttagcccgtacttttgccgtgcaagctcattggttaaggcaatgtcatacaaaccttcttttacttttcttgcggcttgactggttgaattgactagtttgaaacgaacatctttgcgggtaaaatattttattaaattaataggtgaaggatgtgaaacaataacagatgtatcaagcatatcgtctctgaattcaaaatcaggacgaacagccaggccgtacatcggtgtatcgcacctgaagatctgcaatagctgcaaatccggcctcatgtagaaatgcttaatgccatcgtaagcatgtgggacgatggtatattccagcgggctttggagcgtcctttcgatgcatgattcaaaagtatcatgcaaggacaatttactgttcagcccttgtagaagagtaaaattggaaatgaaatgctttgctgcgtactcactgcttgtcccctcagggccgagcgtgttgactgtaatgagtttggatagtgaatcagttcttttttttgtctgaatgctattatccaatataatcatgagcaccaaccaatcttttaaaattttaagtaaattttatccagcggcaattgaactgtcaatgttttttgaaaatattgataattattcccatacaaacaaaaaaaccctttaaaaagggtttttaattataggaatttagaaactttgtttattgagataaggactgatcggccttctgctcaagcttgccgtactttttatatgcgaatatactgagcacaaatccgaggactgtgatggcggcgcaaatcaatccgacagctgcatagccgtatgccacatatacgggtcccattaaagcagaacctaatgtcacggccagattcgaggcgaggctgtaaaacaccatgacttttccgcgatgacgttctgagcagtcactcaaaatggtgctgagcagcgtcaccgtcaaactttgcattaatccccaaataaataggctgacgattaacagaaacattgacgccggcgcatatggtaaacacgccagcagaacgctgatgacccccagcgcaatcaaaagggagcgcatttttccgatgcggtcggctatctttcctgtaatcacactcatggaaaacccgattccataaatcatgataaataagcccgcagccgtgtttcctccggtaaaaacgtcctgaagataggtgcctaaaaaggaatacataccgtaaaaaccaatcatattacagaaggttatcgtgatataaacaggtacacgagggactttcagcgcatcccggaatgttcctgccggctcttctatttcttccttgccgctgtttttatgttgggcatggcggcgcatttcaaggagaatcagcaggacaactaaaacacccatcagggcgaaaatccaaaacgtccatctccaatgcaggacgccgccgataaatgatccgagcggcactccgaaaatcagcgccagcgaccagcttgaaacgatcagccccatcaccttgccccggtatgtataaggaacacgatcaccgacaactgcgtaagcggtcggaacaaacgctcccgcagccaatcccgaaagcgcccggcctaaaaagaagaaaaaaatattttgagccaaagcgcatatcaccgttcctatgataaagatcataagcccggctaataagctcagttctctggagtatttatcgcctaatggaaccaaaagcggcgcaccgataaaaatcataacgccgtaaatactgatagataatgcaaggacgctgacatctgagctgaaggcttttgctaaatccggcagcagcggtgagattacaagctcttcagatccggccgcaaatacccccatcgttaaagccagtgccaacaataacggaaaatgatgttttgttttgatgtcattgttttgattgctgttcattctttctcaaacacctcttccataatcttcttatcataaagttgtattatagtttagcattgttttttcactatttacaattcgaacgaaatatttataagttttattattttcatttaaatcccattatatatttctatatttcattctaaaaatacatgaggatgtaatgcgtaaaaaaagctctccggcctcccggagagctttttctattgtgcctctgtctgctttttttcaatcgtttcatgatttatacgctttttgatgcttagatgatagtatgcataacagaaaataatgatcggcacaccgcagtataagccaattctttgatccggaatgaaaataaggctgatcaacacgcagccatataaacaaaatccgagaatcgggactagcggataaagcggcgttctgaactccagatcattcacatttccgccttctgcaaggaaacgtctgcgaaagaaaaattgcgacgcacaaatggacatccacgcgacaactgtcaccatgcccgagattgagatacaccataaatacactgtttctgcggccatgacacttgtcagcagcgaacagcctgaaatgcctagcgtaatcagcagggcattcatcggcacgcctttttttgtcagtctggtgagaaaggatggacccatttgatttgatgaaagtgaccacatcatacgcgacgccgcatacaaccccgaattagcaacagataaaatggctgttaagatgacaaagttcatgatatctgccgaaaatgggatgccgatttgatcgagtaccgctacaaatgggctttcaatcacccccgccgttttgtacggaaggatggcaaccaagacgaacatagcgagcacaaagaaaaacagcgtgcgccaaatgacatttcgaatggactttggcagtgttttttccgggctttcactttcccctgccgcaatgccgacaagctccgttccctggaacgagaagttcaccatgaccagcgtaaacataacggccagcaccccattagggaaaagtcctctatcagtcataaagttagacaaaaagggtgtctcctgtccgcctttaaagtcaatcaagccaaacacagcggctccgccaatcacaataaataatatgatcgccgccactttgatgcttgaaaaccaaaattccatttctgcaaagcttctgacagagagcgcattaatcaaaaagatgacgatgccgaacacgaggcaccatatccagatcggaacggagggcagccacctttgcatcaaaatgcctgctgacgtcagctctaaccccactgtattcgcccagctgaaccaatacagccagccaatcataaagcctgtcgacggtcccagaaatttagtggcgtaggcctgaaacgatccggccaccggcatggcaacagccaattctcctaaacaaagcatgacgagatacattaaaaatccgccgatgatataagcggcaatggcgccgagcggtcccgcctggctaatggtaaagccagagcctagaaacagcccagtgccaatcacccctcccaaagcaatcataaacaaatgcctgcttttcatgctgcgctgcaattcatttttatgattctgcatcatccttccccctttggttcttttgccgtgatggtcatccggtagctttgcaaaagatgaacggtggtttgctgtatgaggagaggcaatacatgaaatgtgtacggtttatagactcgttctgtccatttatggccgtcttttccgtacacgcccatattaatggatggaatattcagcttgcgtatgtctttgaacggaatggtcccaatcatattccacccagggaagttcctgataaaagaatcaatttcgccatcggtttcgtgcagtgataaaaaactgccgtctgccaagtaggggaaaaactttttgaagacaaatgtttcgcctgtcgattcagcggttttgtcagccgcttcttttatcacatgctgcaaaagctgatctcttgcgctatcttctttcaaatagttatgcggcaggtaaggaggtgcgtaaaatagaatgacttttgcgccttgatcggggtcaagcttttgaagctcttcgattgcctgaaagcatctcatgcgaagttcaaggtgctcgttggctttgaatgtctgctcgatacactgctcgggatctatcccccggtttctcagcttttctaagtattgctccaggctatacacttgaatgtcccatgataaatgtttctttggcaggttggctctttttgcatattcttcataataatctgataatttttgttctgtctctcggcatgcttcctcagtgacttcaataagcaaatccatcatttcttttgctgttctttcataaataaaacaattgaagtacaagctggtgctgacagccgtttgcacattataggattccttgttatcacgctgatacaaacaggatgggggcagaaccaactccccttcaaccttttctgccagatggatgttattgtggagacggcttgtgatttcagatgaaatgaaatttgggtcaattcctgccagtgtatcgccaacatggacttcacgcccgtaaatgtaaaagcaaggcaacagttttcccgcggctccggtatagatatatcttgtctgatcaccatcgtaaagcggggtaataaaatccgtattaatagcagccaaatagtgaagctgtttttctttttttagccggttcagctctgaaatgctggcaagaatgcccgaatgctggctctcctcatcgggattggccataaacaatacatttcccggcaacgtctcaaggttctccgaaaaatgcaggagattggctaaatgcacggcgatgccgctttgcatatcaacagatcctcttccgaacatccaatcgcctgatttggcatcccgctgaacatcctgatcgaactcatagcggctgaaatactcggccaatttctcacaatcaaaagcgatatcctttaaagggccgaaatcttcaattccaactgtatccagatgggcatggtaaatgactgtatttcggctttctccatgtcctttaataaacgcaaaaatatttttgcgattgtatgggtcattgggaatggcctgttcccacacatgactggggttttcctgaaaataaggatagctcgtgatcacttctttgatgaaatctgcttttgtcccttctccaacggtgccgttcacgctgctgaggctgaccagagatgctgtcagcgcctccactctttcagccggattcatgtgactgatttttgtatactgcataaattgtcctcctgattaaaaagttgaaatcgtgcgatccgctaaagaatcgcacgattttatttctctcaaatcaaaaagcttcggacgttgttttggcttgcatatgaagaattaagtaatcgggaccgcctgcttttgagtctgttccggacatattaaaaccgccgaacggctgatagccgacaattgctccggtacatcctctgttaaaatataggtttccgacatggaaatcctcacgcgcccgttcaatgtgcgcacggtttttcgtcagaagcgcacctgttaatccgtattccgtgttattggcaatctccagcatatgatcgaaatcacgcgctttgcaaatcgcaacaaccgggccgaaaatttcttcctgcatcaagcgggcgttttcatcaacatctgcaaagatcgtcggctgaataaagtagccttttgaatcatcgccttctccgccggccaatagcttgccttcagatttgccgatttcaatgtatttcatcactttgttgtaggatgcttcatgaatcacgggacccatatacgtatcaggatcttctggattgccgacagtcagcgttttggtcagcgccacagctttttccaccacttcatcataaacatcctgatgaatgaccgcgcgggagccagcagaacacttttgtcctgaatatccaaatgctgagtacacgatagaggatgcagcaaggtcaagatcagcgtccttgtcgacaagcactgtgtcttttccgcccatttctgcaattacccgtttgagccatttttggcccggctgcactttggcggctcgctcataaatccggcagccgactgcacgggaacctgtaaatgagacaaaccgtgttttcggatgctcaactaagaaatcaccgatctccgctccatctcccggaatgtaattcagaacgccgtttggcagacccgcttcctccatgacctcgacaaattttgctgccactaccggggctgcgtcagccggttttaagagaatcgtatttcctgtcacaatcgctgccgccgctgttcccgccataatcgcaagcgggaagttaaatggagaaatgacgatgccgacgccaagcgcttcgtaatgatattgattgaactcgccagcacggctcttcaccggagccccttccttgagctttaacatttggcgcgcgtagaactctaaaaagtctatcgcttcagccgtgtccgcatccgcttccttccacggttttcccgcttccttcacaagatagcttgaaaattcatgctttcttctgcgcaaaatagccgctgccttaaagagaatattcgcgcggtgctccggtctttgttttttccaggaatcaaatgcctgcaatgcggcttgcatcgctttttcagcaagctcttgatccgctgtagacgcgtacccaatgatctcttctttatttgccgggttaatggaaatgattttgcggtccgtttcaattttttctccatttatgacaagcggataatgcttgccgagctgagtgtttacaaaggccagtgactccccaaatgcagttttattctttgcttccgtaaaatcggtaaatggttcgtgtgcgtatgtgactgtcatatgtagtccccctcgtgttatgaaatatatcttcgcatatgaataaaaatgcaagaatcatgccattttcttgtcttttgctgaaaaaacttgttgaatcgaacagaaatttgtctaacaggtgatcatctttctctatttccgatcttgaacgcaaatttattttgcgatttttgctctttaggcaaaaaacaaatgcaaaattattttgcggaggcttctcaaattagacccatccgcggaatcgcgatgcttctgccgattttctgatgcccgtcatgtaagccgccaaacgcatatccactttatgtgttgccgctgtctgataaattgtttcgaacgagctgaccatgacgcttctcaatttttctgcaacctcttcttccgaccaataatatccttggttgttttgcacccattcaaaataagaaaccgtgacgccgccggcactcgccaggatatccggcacaagcagcacgcctctttcattcaggatcttagtggcatcaatggttgtcggtccgttcgccgcttcaacgacgattgacgcctgaatgttatgtgcgtttttggctgtgatttgattggagatcgcggcaggcactaaaatatcgcaatccttttcaagcagctcctcatttgtgatgacgtcagtaaataaattggtgaccataccgaagctgtcccgtttatcgagcaaataagggatatcaaggccgtctgggttgtagagcccgccattggcatcagaaatcccgatcaccttcgcgcccgcatcgtgcatgaatttggccaggaagctacccgcgtttccaaagccctgtatgatgatgcgcgcgttttgcagcttgatcccttttttcttcaccgcctcttcaatacaaatcgtgacgccctgtgccgtcgccgtttcccgtccttgcgatcctcccaaaacaagcggtttacctgtaataaagcccggagaatcgaattcccgcagccggctatactcatccatcatccacgccataatctgcgaattggtgtatacatctggagctggaatatcctttgtcggaccgacgatctggctgatggcacggacataccccctgctcagcctttccagttctccaaatgacattgtccgcggatcacaaataataccgcccttcccgccgccgtaaggaagattggcaatcccgcatttgagcgtcatccaaatggataatgcctttacttcctcttcattaacttctggatggaagcgaacgcccccctttgtcggaccgacagcatcattgtgctgtgaccggtagcctgtgaacactttgacgctcccattgtccattttgaccggaatgcggacagtgagcattctctgcggctctttcatgagttcatacatatctcccggataacccagcttccgaagggcttccttaatgattgtttgggtagacagaaataagttaagagcttctttttcttcatctttcgagacttgctttgctgacatctttttcacctcattgtttttttggccggctgtaatgtaaacgctttaaaaaatcagcccgccaattcctttctgcattggattcacccttatcatcatgcaagatccgtaccagcttttgaatccacaaaaaaagagactgaaaacatctcagtctctgactacaaatctatcgattaacggggatcaatcaccagctgcgtttcagcataaaaactgccgattcccaaaccgtttactacatcgcctttaatcgtgtaagtgcctgcgcgaggaagagttttacgcaccatgacaaggtcaaattcggatgcgcctaacaaatcaagcgtaagcggaagtctgactgtttttccatcgtttaaaatctgtgtttctttcagtgttcttccattcactgaatctcttgtcgtagcatgaaacccgtcaggaaattgaaattctaccgctccaagagaaagcaccgcatttggtttatatgtcacttcaatatcagaagtggtccactctttcgtgctgttaactgtttttgcctcgattgatgcagactgtgcatgagcttggcccgaaggaagtaagattgatagtaaaacagctgaactgatgaataatgaagatacgaatgaagttctttttagcatgacatttccccctaattgattgttgaaatttggccagagcgtcctctgcagaaaaagcgctttttcataattcgcgaattaccagttctttttcttaaaaattaatctatcatcattttccatggaagtaaatgttttttaaggaatattaacacttggaattcaatgagaattccttcctgtttatacaaggttcaaatggacgattctcctctctttttctagtaaaatctgcctgacattttatatcttttatcctattttaaaaaagggcaaaaaaagtcgaagatgcctctgctcttcgattgatcacgttcctatttttatctgaattcagtgttccagttaaaaccgatcgtctcatcatcccacggaattcttttttcatcaggctgatccgggttatacgacatggtggtaaaatagataattgtcagcggcgtctctcccagcactctatatccgtgagccaccccttttgggattaataacagcatcgggttgtcttcgcccatataatagacgtccgtttctccttttgtctttgaatcctctcgaagatcgtataggacaacctgagcgtggccggttgggaagaaccagagatcatcctgcttctcatgataatgaaatgccttaatcacacccggatagcttttcgaccaagaggcctgcccaaaatgctcaaggaggttctcatcgtcccggaccagctcagcaaaaaagcctctgtcatcgctatgcttcatcaattttttcaccttgactccatcaatcacacgcactgctcctttcctgcaaatactctcgtaacgcttcccgccagtggcgggggcggatgtcggcttcttcaatagcccgatggctcagcacagagtatgccggacggggcgttttgttcccgtattcctctgtcgttacaggcaaaatggctgtttccagcccgctttcttccataattgccgtcgcaaactcataccagctgcatatgcctgaattgctgacatgatagatgcccggcggatggctgaacagtttgatgaccgcttctgctaaatccttcgtataagtcggcgaaccaatttgatcgctgacaacccgaagctcttgtttcgtttcagcaagcttcagcatggtttcaacgaaattactgccgccatgtccgtacacccacgatgttctgatgatcgtgctgtcttttgtcgttaatcgtatcagttcttctccgagccttttgcttttgccataaatggttttcggatcgaggggatcatcttccctatatggctgggttcctttcccattgaatacatagtccgtgctgatatgaacatattgagctccgatgcgggttgactcaagcgctgtataataagcgccgattccgttaatcaagtacgctttatcaagctctttctcgcattgatcaaccgacgtaaacgcggcgctattgaccacgatatccggctgataatggccaaacgaatgccgtactgagcgctggtcagcaatgttcatcatcttctttgttaacgcaatgacctcatatccggcttgcttcagctggcggcatagttccaagccaagctgtcctcccgccccagtcaccaatacctttgtcaatcagatcaccttctcatcggtcattgtctgtataccactgaatcgtacgcgcaatgccttcttcaaacgtcacttcctgccgccagcccagttcatttttcagcttagatgcattgatcgcatagcgccggtcatgcccttttcggtcttccacgtgggcgaacaattcctcacagcccagatgcttcaaaatggcactcgccagctctttattcgtgcgttcatttccgccgccgatgttatacacctcgccgtcggtccctttttctaaaatcagcttgatcgcgcggcaatgatcctccgcaaacagccagtctcggatctggagtccatcgccatacagcggaacaggcaggccctgcttcgcatgacggataatcgtcggaatcattttttcgctgtgctgataaggtccgtaattgttgctgcatcgtgtaatgatggccggaagcttgtgggttttcacataagacaacacgagcaaatcagagcttgctttgctggctgagtatgggttattaggagaaagcggcgtcgtttctgtaaacgcgggatcatccgcttttaaatccccgtatacctcatctgttgaaatatgaatcagcttcttggcttttcctttcaagaccgcttccgccaatcggtatgtccccatgacatttgtggtgataaacggctctgcttgggaaatgcttctgtccacatgcgattctgctgcgaagtgaatgacgccatcgtaggtctcatcaaacgcgcggtcgatatcctcctgaacgctgatgtccccttttacaaagcgaaaacggctgttttgctttaatttttccatttcctccgggtggctggcgtacgtcagtttatctaaaacggtaatgcgcgcatccgtttccctcagcatgagctttgtaaacgtgagcccgatgaagccggcaccgcctgtaattaaatatgattttgccatcacttttcgtcctgtcctttccgtaaagcctggtgtacaagctgggaagcgagataaagcgattcgtgagttccggcatctacccaccagcctgataacacatcatacgtaagctggctgttttcgatgtatagattattcacatcggtgatttccagctcgccgcgctttgatggtgatatttgttcaatatatgaaaacacctctgcatcatacatataaataccggtaacacaaaggttggtcggtggctgttcgggcttttcgatgatggaacgaatccgcttgtttttctcatcaatctcagcaatcccgaagcgttccgggtcatcaacttctttcagaagcacttttgctcctttcccctgctgttcaaagcgttctgtataaggctttaatgaatcttcaaatatattatcacctaataataaaatgaaagactcttttttcgtaaagcgctttgcataagacagcccatccgaaatgcccgatgctgccggctgtacttgataagtgatagtaacgccaagctcttccccgttcccaagcagtttgtaaaattgcggcatatgctccttttggctgatgagtaaaatgtcttttattccggcttcctccagcttcataatcgaccagtatatcatcggatacgggcctacaggaagcaaatgcttgttgacggctttcgttaagggcataaggcgtgagccgtttcctccggctaaaataacacctttcacattaacacttccttacatgcatttttatatctcttgttcatataaatcttgaagaatagctgttacccgtataatgcctttgccatccacgagcggccttcctcccttgtgcaaagaaaggcgaagaggatagctgctcataatgcgtgacatctgatagatgagtgtttcatccggtacaagctcacccaagccaagatcaagagcggcgccttggtcagcaaatgttttggctgttgccgtttgatgcccaacctgagaaagaacaaggcacggcacgccgatgcaaatggcttcatatagagagatgccgccggcgacaatggctgcgtccgcttgtttcatcaaacccgccatatcatttgtctgttcgatcaccttgtactgcggcttcttttcgatccgccttcggactgcctcttgatgcggtgaagcgctccccatcacaaaaatcatgtttttgtcttttatgccggggacttgatcagcggcagccagcactttaaaaataagctgcttcggatcacttcctcctaatgcaacaaggatattgcggcagtctttcttaagtgtgtaatcctctcttgcggcctgaaaggcggggtgaagaataagatagtccggaccttcataaatgcgtgtgtttccctgaacgtacaccctgcttctgatgtcaccgtaaattccgttaatgactgcgtcactatattgaattgatttaccgtttttctcttcaaaaagaacaattttcgcatctgtctccgtctttattttctttaacagctctgcaggcgcgcctagaatatcaaacaaaagcaaatcaagcttcttgctttttatttcccggagaataaattcgtgctgctgcagctccggctttacgatgacacgccaatgctcttcatgaagaaacgcttcagactcctgattcgtataaaacgtaatcaaacatcgctgtttgagcccctccgcaagtctcttcatccggacaacatggcccattcccttttcatagccgccgtctgcgaagatcccaacacgcatggctattcagcctctcgttcgattgccgcatcggggttccggttcagaagggtgataagctctgaggcggatacaccagggcgctcgcctgctttttgatagagggcctttatcgattcatagtcttcctttgtatcaatggtcagccgatattgaggggcgcgaaatcgttccggcgcctctaaaaactgaacacgataaagagctggatgattccttatatataacgtgacatgctcctgatattgatcctccatattctgaatacggctgatgtcaattaataggttggcgttgaccacttcgccgcaaatccctaatggggcattcaggatatacgtataatccgatccttgatcaaaatgcgccttaatcattacatcgagcagctccggatcgacaaacggattatcacccgttaaccggatgatgactgacggtttaacagcttctatgaccttcacaaacctatcgaggacacgttcttcgctcccgcggaaaacacgaaagccttgtttgatacagtgcgcctctaatatgtcgtcagtttctttgtcagacgtggcgatgacaagattatcccgatccttttggtaaaacgcgcttttccggacacggtgaacgagaatgtcaagtaaacgattcgatccgagcggccgaagcacttttcccggaagccttgttgaacccattcttgcttgaatgataaagagaatatcattcatgaaacgggctgtccttcagtaaaatgtcatcccagacaatgcctgtgtcggctggaatgtctcttacagcccgaacaccgctggtcagcagttcaaaaaatctcgggtgcagcccctgcggcttttgtccgggccgaagcactgcgatattgtcttcactaaaggcttcacctttttgaatcggagctgttgtaaaaatgcctctgtatgcaaaatttctgatttctccttcgatggaggttgttgttttgtatgaactgccaagcagtttttcagagaccggctttgtgatcccctgtttcagctcagcttccgttttcctgatgccatcgaccatttctttcaattcatccggatttaatgcaaacgagtggtcggcacccggcagatctttatcgatcgtaaaatgcttttctatcagttttgctccgagccgaaccgcggcacacggcgcttctgtcggatgctcgctatgatcggagaagccgattactgcctcaggaaaagcggcggcaagcatcggaatgacgctgaggttgctgtactccggcggtgctgggtatttcgccacacaatgcattatggcaatttgattgtttccctctgccctgatggtgcgccaagcttcgtgaacatcagagatttcagctccggctgtcgagaaaatcatcggcctgttcagccgggcgacatatttgagcagcgggagatggttaatttcataggatgcgattttaaaagcgctcggcgaggtagactgaagcagatcagctgacccctcgtcacataccgtacttaaaaagatcacctgcttttcgcggcagtaatccaatagcggtaaaatccactcagcgggcatttccatagattgaaccaaagaaaaaatagagacgtccttgcccgctgccgtcttgtacaaaccaggatctttctggtacatcctatcagcttggaacatttgaaatttcacggcatccgctcccgcttccgccgcggcgtctatcagcgcaaaagcctgatcaagcttcccgtcatgattaatccccgcctcagcaataataaaaacaggagcgtctttgcctacagttttattcgcgatctgaaacgctgccattatttcgcctccttgcccggccaaatatgataatagtaatacgattgttcagcggtgaagcccattcgttcataaaggcggatcgcccttacattgtgaagctgcgtccccgctgttaccgttctatgcttctgggtctccggttgttctatgagattcgccaataaatgaaatgcaatacgttttccttcaaatcccggctttacagccatcaaatcgagaatgcattcatcatctcttgataagccctgaagatagccgatgacctcgccattgtgtttagcgacaatattgaccgccgcccttccattcagattgtttcgtgtccactcctgaaatattttgtttgctgcatcgcggctgagatgaggatcctgaaaatatctgctttttgtaaacgagtctcgggccagctcacatatcgcttctgtgtccccgggctcaggcgggcccagttcaaaaaatggcggtgttttgtcataaaaagacggaggcatcgccagcttcagcaaactcccgacaaagtaagaggatggctgctgctgtatcacatgcgcggctccgatatcttcagccggaacgcggacaaagataaaatccgtttcatccatttggcgtacagtataaaaagcttcaaacagcctctttagctgcccggtactatttgccgcaagaagtttgacgttgatgactttcttctgaagcaccttgctttcccacaaagaatcttcgtaaagcaatacgccttggagcctgctgttttcaaaaaggccgagggaaaattgatacggaacatccagtgtaagctttctgctttggagaaattcctcaattgcctctttggagacattttcttttaccgtatacacttaatcagccccttttacgatatcccgcacagcttcaatgacatcatctacatcgtcgtcagacattgatggatagagcgggagagaaagggttcgtttatagtaattcatggcattcggaaagtccgcttccttatatccaaattgcttttgataatacggatgaatgtgtactggaataaaatgaacgctagtgccgatattgtatttatcctttaaagccgtaatcatttcgctgcgcgtaaccccggcttttttttcatcaacttgcagaacatatagatgccaggcgtgcctgccgtcatcatggacaaacggcgtgatcagcccaggaatctgctgaaaagcggtttgatagcggccggcaatctcttctctccgtttctgcatatcatccagccgtttcagctgatgaagtccgagggccgcctgcaaatcaaacatattcatcttatagccgggcgattcgacttcatagtaccagctgccatttgaagaataacggttccatgcggctttactcatgccgtgaaggcttagcacccggatcttatcggcaagctcctcatcatcagtcgtcagcatgccgccttcccctgtcgcgaggtttttggtggcgtaaaagctgaatgccgttgcatccccgatagaaccgatcattctttgcttataagtcgtatataccgcatgtgccgcatcctccagcacgaataaaccatgattttgggcaacagccaatattgcatccatatcgcaggactgcccgccaaagtggacgggcacaactgctttcgttcgcggtgtgacggccgcctcaagctttaccgggtcaatattgagcgtgttttcgtcaatatccgcaaacacaggcgtcgctcccgtatgaataatcgtattggcggtcgagctgaacgtaagcggagaggtaatgacctcgtccccgggcccgatcccttttgctttcaaagccaaaaataaagctgcggtacatgaattcaccgccacggcgtgcttcgccccgacaaacgcggcaaactctttttcaaactgctgaaccttcgggcctttagaaagccatcccgattcaagcgtttctgtaacctcctgaatttcttccttaccgattaacggcaatgagtaagggagaaaatgatttctcttttgcaccatttctttgcgctcctatcattttattcagtatcttcccgcctgtaatcaacccctgttttggctttcagttccgcaaataaagcatttgttgattctgccaccggataattagccgctatgaatgccaggcgcgcctcttctgctttttgatgcacgtcgggacttcgaagaacttcaaccaaggtgtgcaccagttcatccggctggtcaaacataaaatcgccaagagactcataatacggatacgagcgatttccggacgattttccgatcagcacaggcttttgaaacagcatggcttcaagaccgactgtcgaggtctgcgtcactgcggcatcagcatacggcagcaaatcataaagctccagctcctttttgatgactctgcatgctttatgttttttcgccgcctcgtgatacagatcaagcttgttttttccgatttcccacgggtggggtttgataatgatctgcagctgcttctgatcagaaagcccctgcagcacaccggaataaaagtcttctgaaaagggctgagtggcaatgagcacaatttttttagtcggctgaaaagcaagttttcgatagaatatggacatatccataggcgttctgttaaaaatctgatcgaagcggggatgtcccgttacgagaatctgctcgggtttacagccttttcgtatgaaccactctgcttcatacgcaccaaaaacagcttgataggttgtaaaaacaggaatgaaggcttcatctcccatcaatgcgccatgctgaagacaaatgctgacggccccttttctttgacacatgagagcgagcaccctgctgtaaatgtcttctgccgttccgacaataacagctgaaatcttttcctgttcaaacagcgcatcaactgtatcaatggcctctataaataaaggaatatctttgaaaagccggtcgcgaaacgcttgatcaccaaatgccgggtgatcatcataaggggcgagaagcgaacaggctgtttcgagatactgcttcgaatcgcctttttggcatgaatccgcaatctcccgcttgctaattacaggcagatcacaataatgcggcaaactccatctggccaaaacagccgttttttcaggatcaaattgatagtaatttccgtttgaaaaacgcaggtaatcaaagtgcaaaatgactttccctttaacaggtttgtcatttgttttaacgattttttggattctttcttcaaaaaacggctgaatctgtccctcatcgatatgctgatccaccgatccgaataattccggttcttcttccatcatcaccctcagctcagggctgatgtattgataaaaattactgataagcccaagcggaatccctttgtagcgaagtttgtcaaaaagctccacgtacttccggtacagcacccaataattgcttaaataggccgacaagctctcaccccattccaagcttttttaatgattcacgcagctctcggcaatttcgctgcggaggaaggttcctgacaaattcatttttttctgattcaaacagctgaaagtgaatcgattggtcggtaatataattcaggtccagctcctcatccagtgggtaaaacggataaaaatgattgactctccaaaagaaccgcgcatctcctatacggtaaaacgccgggctttcatcccaataggagccaaacttctcctttaccttctcaagcaccgaatacctgtgcatcaccgagcaatgatcaattgcgcacggtgcgttccatgtcacttgagcggcaggcctgacagtttcttttacaatgtcgcgattctcgtttaaatgataggttttggaggctgagtaaatcacagccttttcaggatgggtatcgagctcccgcaccattttcaggaggcggtccggcatatagatgttgtcatccgtcgcataggtgatatattcaccctccgccatctcaatcgcctgattgatcagtgccgcgtatctcgttttttctgttctttccttcactccagatatatcgctttgataaaaacgcactcggttatcattcaaaaaaggacggattacattcagcgtctcttcattggagttgtcatccataataaacaattcaaaatctgaaaatgtttgtgagagtatgctagaaatggactttgccacataatcgcttttgttatagctcgtcataatgactgatactttaggcaaatcctacacctccttcttggaacttcacacctgaaactatcgttatcttatgttgcttatgctcaagttgcgctagggatacaaaccaatatgcgaaaagtttgtgtatgtctctgaaaaacagcggctgcccagagcgaaatctgatcggtccgctgttctttttcagcataatccaagcatcagcctcataaggtgaaagagataaaaatcgcaccagcgactaagatcgttttccatcggaggtgagtcatcgcggagcgttcacctatacatccagaacatgttttgaatggttttcataaaaaggaggaacgatatgaaaccgaaaaaaaatcaatatcagcaaatgcaggcatttgataatatgcaggggtatcagcctcagtttggcgccaacccgtacccgcagcaaggccaaggctcacaaatgcagccaatggggatgcagccaatgatgccaatgcagcagggacagcaaggacaacaaggacagcagggatttggattcccgggccagcagcagggcggcggttttcaaattccatcggggcctacaccgtcaggaccgggccaaagcgttcccggcatgctgcctgttgaggaatcttacatcgagaatattttgcgcctgaatcggggaaaaacggccaccatttatatgacatttgaaaacagcaaggaatggggctcgaagatttttcgcggcgtcatcgaagctgcgggccgggatcacattattatcagcgacccgaaatcaggaacacgctacctgctcctgacaatctacctcgattacattacatttgatgaagaaattgcttatacgtatccatattccatggcgtcctattcgccaagataagaaaaaagccaatcactcatatgatgaggattggcttttttgattatagatatttgacggctgcgacaacgatcataatccaagaaataataaacgccacaccgccgagcggggtgatcgctccaagaatggagatttgcgtcacacttagaatatataagcttccggaaaacagcacaattcccgcaaacatcagccagccggctgtcgtgacactgcctatgccggataatttatcagccagaaacgcgacaacgaataacccaagggcgtgatacatatgatactgcacgcctgtgtgccaaacctgaagatatttatcaggtattttcccttctaatccgtgagcgccgaatgctccgagtcccacggcaagcagggcgttaatagcccctaatatgataaaaactttcatctatctctcccgccttttcgttaaactcatatcatttatcttatcgcacctgcaccaaaattcaatgtttgttctccgttgacacgagattgtcggattttctcctgcgccaaagctggaactggtcagctgctattgcagcaagcgtccctaatacgagcccgttgcttaatagagaaataaataccggatgcaatccctttaacgcagtttcaggaacaaacatgataccgacccctgtcagcagtgagatgccgatgatagacctcaccctttttgattcttctttctcatacgaatcaaattcggcaaaggccagaccgcccattgcggagaacacaacaaaattcaccgcaaatccaacgggtgacggcaggctcgcaaacgtattcataaaaaacgggatcacgctgattacgataaccagaatactgccgagtataaacggttttttagaaggcatcttggtcgtttcaataaaacctgcggctcccgaaatcggaacaggcgcaatagctcccgtcaaaccgctaagcagatggctgaatgaagctgcaaaaccggcatggcgttcatgatgctttccatcaggctgtttgctgaattttttcacggcgatgtccacgaccttcatgctcgccagcatattcacgatcagcaagatggtaataaaaatagaagtgatgatcaggccgctgttaaataacggtggcccaaaaggaaacagggaaggcagctgaaacagccggtccggcatttcaatcggctttgccgctccggcagccgcaaacagcacccacccgccgaacaaggctaataaaatagaatattgcttaaaaaacacgatgttcgaatttgtcattataaaggcggcagcgatcacaacaagcgccaggccaaatacaagaccgtccaccccgtcctgtcgataaccgattccgagaattccttttataatgggctgactcagctgcatgacaagaagcaataaatagacgcccgttacaaccggagtaaacaattttgcaagtctgtcaatgaccttgaaaacacttaacaaaaagaaacatacagcgcttacaagaagagctccctgcaacccccgcagtgtgtctccatatgtcgcaaacacagttcccgttagccctgcgtagatcgtatacactccccaccacaagccggctgggctttcattgatcggcagtctgtggcctttcaaacactgaatgacggcggcaatccccagtacaaaaaaagtgctttgaatcaatctcgcagaatctgagtgatccagatgaaacgactgggcaaccgccaccggaacaactatcgccgcagcaatgataaacgctgtccattgcaacgcgccaagaaccaatttcacgtaagctcaacctctctctttaaaaatcaaataaagactctccgtttccatcctcttcctgcttctctttttcttgctttcgatatttgtttaatcccgcgctccccatcattttttccatcatcagctggtctgtcgatggcggcgcggcaggacttggcgtaacgctcggctgtatgcggggcgcgctcgcgttctccggctgatcaagcacgacatcacacagagaacggacaaccgctacataacgcttcagctcctcatcccgttcagctgtttttgcttttttcagctcctcttccatcttttgaattaatgcagatatatgaatgttcatgaagcaccctccaaaaaaataaatgttgtcttcctgcattttatcaaattcctgctgtaaacgcagatatgagtttgttattttttctgacaaaccttgcgcgattgacaagcagaagagatttttcacataataaatcaccatacattacaaaaaggagaaacggaatgaacagcatcccctctatcatcagcaagcataaagcctattttgcggcgggacatacgagaccgcttgaatcgagactgaacattttgcgaaagctgaaacaagccgtcagaactcatgaagccgatctcatagccgctctctaccaggatctccacaaatccgagcaagaagcatactcaacagaaatcggaatcgtcttggaggaaatcagctttgtcatgaaacggctgaaaaaatggtccaagccgaaacgagtcaaaacgccgctgactcatctaggctccaaaagcatcatcattcctgagccgtatggaaccgttttggtgattgcaccttggaactatcccttgcagctggcgctttctccgttgattggagccattgcggcggggaacacggtcgttctcaagccatcagaatatacgccggctgtttctgctattctttccaaactcatcagcagcgtttttccgaccgattatgtcgctatggcagaaggcgggcccgatgtcagcacagcattattacagcagccctttgactacattttctttaccggcagcgtagccgtgggaaaagtcgtcatggaggccgccgccaaacaattaattcccgtaaccttggagctcggcggcaaaagcccctgcatcgtccataaagatgctgacattcagcttgccgccaaacgcatcgtcttcgggaaatttacaaatgcgggacaaacctgcatcgcaccggattatttatttgtccacgaggacatcaaaacgaagctcacagaagaaatgaaccgtgcgatcagagaattttacggccctcagccggaacggaatccgcagtacggcaaaatcgtcagtgaacggcactatcagcggctgctcagctttctgaatgacggcatcccactcacaggcggacaatctgatcccaatcatcacaaaattgcgccgaccattctcgaacaagtgagagatgactctccagtgatgcaggaggagattttcgggccgattcttccgctctttacataccgcaatatcggggaagtcattgagaaagtccaatcgcgccctaagccgctcgccctgtatctcttcaccacaaacaaagaaattgagcgcgctgttttaggaaatctgtcgtttggcgggggctgtgtcaatgatacgttaatgcatgttgcgacgccgtatttgccattcggcggcgtcggggaaagcggcatcggcagctatcacgggtttgacagttttaacacattcacgcacaaaaaaagcgtcgtcaaacaaacgaaccgtttcgacttcgcatttcgttatccttcctccaaaaacgggctgcgaatgattcgaaaaatactcaaataaaaaagcgcagataacctgcgctttttacaaatccttaatacaccaatcaatcggcgcctctcccattttctccaaataggcattcgcccgggaaaacggtctgctcccgaaaaatccgtttctcgcagaaaacgggctgggatgcgtcgattcaatgataaaatgcttggacgtgtcgatccgttcttttttcatttgggcatgccgtccccacaaaataaaaataaccggccgctccctttcattcagcacgtcgataatccggtctgtcagtcgctcccagcctttccccttatgggaattcgcctgtccgcgccttactgtcagcacagtattcagcaaaagaacgccttgctttgcccagctcactagcgatccgtgatttgggatgctgcacccgatgtcctgctgcagctcaagaaagatattttttaacgaaggcggctgctttacaccgggcttgacagagaagcttaaaccttgagcctgtcccggcccgtgatacggatcttgacccaaaatgacgaccttgacatcatcatatgatgtataatgcagcgcgttgaaaatatcccggctgtccggataaatcgtttgctccgcgtattccctcttcagcatctctctgagctcttgataatacggtttctcaaactcttcctttagctgattccaccagctgtcttgtaaaagctgtttcaagattcaggcctccttacgaacgatgaagtctggaatagacaggctcgccatcccaaaccatttcactttttgcttcccgcctcttcatctcaggctcttcaagcaggacggcaaagtttttcgtcggcagctccccgagtccgtgcttttcacttaaacgatccaaatattgcttccgcttggcgccaaggtccgcagactgattgtctcccacgtcactgaaggcataaatcacactggcgcaagggacacgcttcacccggtaatccttggctgcgcgcagataaaaatcccaatcccagtaattgtgcacatcagcatcgaaatacccgatttcatcatgcagaaaacgtctgtacatgctgcccgacggcacgtatgtagaaaacactctcatatcctcatagtcagcggtataagcaaacaatttccgtgacactggataccttgttccgtttttctcttcaaacgaaactatttccgcatcagaatgaacgaagtctgccgtttctatttcctttgccattttctcgatatgccctggcgtaaagaaatcatcgtcatcacacagcataatgcaatccccagacgcctcttttacaccggcatttctcgcagccacatgccccgagttcttttctaaattgatgacagcaatcggtagctccggatacagtgctttgaccggcacgaccgattccccggcatcattcacaataataatttcatacggcttcaaggtctggcgggaaatcgactccaaaagctcacacaaagccggaatccgattataggtcacaattacgatagaaatcttcatgatgctctccttctcattttcatagtcatgtactattaaaacatatattggacgggagatcagtgggaatatcctactgaaacggcatactacaatgatagaaacagcaaagtggctccgatcagaagcaccatgatcagcatcagatctccaaagacatgaaagaaatctttcatgcggacgccattcggaaggataagacgccacagcttagattgatagaccggcagcagcaccagtgcataagaaagacacaaaaatgtaaaagccggcggcacaaaagcacagcctgcatcgtcccaattcatcatgatgtctttcatactagatccatccaataaaaacaaagatatcatgagggctagcaacacaaaggaccccaattgaacctcaaacaggcgcattttctggttatatgcaaatcggaccgcccaaaaccagacataagcatatgaacatagcagcgtaagaatggcacctgctgtaaagacgacatcaggcagccgatcaagcagaaaaacaaaaggcaagctggctgccatagccaagagcatgcagccaccagtaaacaaaaatactgccccatgagctacaaaaccatataaacaagagctaatcctcacgacatacacctcctttacatagaaattctatgtatatacctaaaaaatcagacaagctgacgcctgccaatataacagcccattcggccaaataacggaaataacagcgttgcaaaagcacaagttccaacaaaccaaggtgtcaacaaggattgaaacagcgcagcaggaattacattgaatagaaaaacaagcataaaaatgacgtttggcaccattgagatcagaatcgtatgtagaacaagcttttctccgcgttttccaaactccttcacgccttgatacccaatcagcacccagtagatcatatatgcagctaagatcagccaaacagaaacagaaatgcctttccatactgcttgaacaaacggtgattcaagccatacatgcattattgtaatcgcaatgccgacagcgaatagggcactgttacagaaaagatggaacatcaaaaacgcacggaacgttactggctgtattttcttaaacgaagaaacaatgtcagttggtgttccaaacgcctgcaataaagtctgcatagcttcctcctcactctttccttcctgaaaagagcgaaacagatgatgttcaatatggctctcaatctcttctatcatcgcctcaccctcaggaagccctttaagcccgcttttgatttcggatacatatgtttctttatccattttgtccgctccacttcagtattcggtccatcatggctgaaaatacgctccattccttcgtgcgttccgccagcacttctttgccctcgtctgtaatccggtaatatttgcggtccggtcctttctcctgcttctcccagtaggaagaaatatacccttggcgttcaagcttgtgaagagaaggatacaaggtcccttctttcatctgcagttcatttccgctgcggcttcccatttcttttacaagctcatagccgtacatcggccgctcgttcagaagcgtcaataccaatataaccgtgcttcccttaaccagctcacgatttaacatctcaaaacccctacctagttttcttatgtagcattttacgaaagcccgttgagattgtcaaatgattcctatagatcttctatattgtgatacagagaaaatctaactataatgaaagacaaaacacgatggaggttcaagacatgtctatgcataaagcactcaccattgccggctcagattcaagcggcggtgctgggattcaagctgatttaaaaacatttcaagaaaaaaacgtatacgggatgaccgccttaacggtgatcgttgcgatggacccaaacaacagctgggaccatcaggtattcccgatcgatactgatacaatccgcgcccagcttgcaacaattacggacggcatcggcgtggacgccatgaaaacaggaatgctgccaaccgttgacattatcgagcttgcggcaaaaacgatcaaagaaaaacaattaaaaaatgtggtaattgaccctgttatggtttgcaaaggtgctaatgaagtcctttatccggagcacgcccaagccctgcgtgagcaattggctccgctagccactgtcattacgccaaacttgtttgaagccagccagctcagcggcatggatgaactaaaaacagttgacgatatgatcgaagccgcgaaaaaaattcacgcactcggcgctcaatatgtcgtcattacaggcggaggcaaactcaaacatgagaaagccgttgatgttctctatgacggagaaacagcggaagtccttgaaagcgaaatgatcgatacgccttatacacatggcgcaggctgtacgttctcagcagccgtgacagcggagcttgccaaaggtgcggaagtcaaagaagccatttacgcagcgaaagaattcatcacagcggccattaaagaatccttcccgctaaaccagtatgttggtcctacgaagcattctgcactgcgcctgaatcaacaatcataaacaaaaggggctgcctaacaaagaggcagccctttttaaatcaccgaagacttttcacagaaaaaactgccgatcccatcggcagcctgtttatttgatttttaaattgtttgcagatttcctcaaaaatgtttctatcgactgaacaaaaagtgcatattccttcatttgttcatatgcccgcgtgagaatttccgccgtttcactgtgcggcgttgttccgccaagcatttttttcagctgaagcagcacatccttatattcttcccgcttatcttcaacttggttagcagccttttccaaacattccggtgttatcttctgttcatttatattcaagaaaacaactccttttacagaaaaaaatagtaggttatcgttgaagaatagcacagatggctcagatttcacataagaaaatagaaggattttctacataagtgtccaaattctgacattcatttcagatttcccggtcgaactggctgttacttcatgatttcccgggaaaggaaaatatctcgcactaaagacctcttctccgttattgataaagatttcaacagaggatgcgtcgataaacatgtgcacggtatgcaaatccttgatgcggcaatgtctcgcttctgttctttttccgtcaaagccctttcgttccagcgtaacattccccttgtctttatggaaggaaaacgtagccgttccgcggatactgattgaaaagcctgactctgtatgaatgtcttccagcagaatctcagttctttcaggtttttccactggaagcgtaccagatgatccatgcatgttgatgtgtatttttttctcatttctgcgcatggcttttagctcaggcagcggctgctgaatcagcttctcgcctgatattgtcagctgtctcggcagcgtcatgcagtgaatccagtgatagtcaatcgtcggatgagatccttcatcctggtcaggcacagccatccatgcaaacaaaattcgtctgccctgatcatcttcaagtgtttgcggcgcgtaaaaatcaaaaccttgatcaagttccctaaaatcaccatgcttcagttcaggcttgttataatcgagacgcccgacaaaataacctgactgatatacgttctgataaaggaaaccgtcagcctcaagcccttgaggcgaaacaatcagcacgtccgatccttgaagggaaaacaaatcagggcattcccacatgtatccaaaatcgtccagcccgttgaagcccgcgccggttatcgggccaagaaatctccactcactcaggttatcagaagcaaacaatacagcctgccctttcaaattctctgtttgcgcaccaatcaccatataccatgtgccttcatgctcccataccttcggatcgcgaaaatgcgccgtatatccttccggaaggcgggcgacaacaccctttttctcaaaggacagcccgtcgtcagaaacagcaaggcattgatacgtttcccgatttccatcctgatccctgacatttcctgtgtaaaacagatagagccgatcgtctttcgtgacagcgctgcccgagtagcagccgtttttatcaaaccaatcactcggagccagcgcaatctcttcccgcttccaattcacaacatcctgtgtcgtataatgcccccaaaattttgcgccgtgccccgtctgaaacggctgccactgaaagaatacatgatagctgcccttccaataaatcacgccattcgggtcattcagcagcccaaccggcggcatgatatgaaaatgctggcggtgcggatcgctgttagcgatgggctcttttttctccacttcttcataagcccggcgacgaagctcctggtcatgtgctgtcattttttcctctcctcatcctcattaatcttcatgacaaatgctgcaatgaacgctgacactgctgcaatcgccatgccaatcagatagtgaatcaagttgctgacgccaaacggagccgcaatggcgatcatcggaattcccgttaacccgtaagcgtttgcagctacatgtgtaaagacgacatatgccccacccaatgcgcctccgatcatcgcggcgataaacggttttcggtagcgaagattgactccgaatatgacgggctcagtaatgccgagaaaagcggaaaatgctgccggaagcgcgatttcttttgtctttgcctttttcgccataaagaagacggcaaggcctgccccgccctgtgcgacattcgccattgaccagataggcagcaagtagtttttgcctatatctgcaattaaccccgcctcaatcgcatggaagctgtgatgaacacctgtcagcacgatgagtgaatacgtgcccccgaaaatcaaacctgcaacaaaaccggcatggtcatacacataagttaaagcaaccgtaatcccggagccaagggctcttcccagagggccaatcgcgataaaagcaacaaacccggtgacaattacagtaacaaaaggtgtaacaagcaagtctaccgcatgcggaaccacttttcttgtccatttctctaccttgctcattacataaaccgccagcagaacagggatgacagttccctgatagcctagaagcgcgatatcaaatccgaaaagatgcatataatcaggtgtggcttccgccaatccccatggatttaaaagagacggatgaatcatgattcccccgatgaccgctcccaagtatggattgctgccaaactcttttgaagcgctgaccccgattagaatcggcaagaaaatgaatgctgcacttgaaaacatatcaagcagctgcaaaagcgcagaatccttgctcatccaatgaaacgcattgatcatacccagcaatcccattaataggccgctggctacaatagccgggatgattggaacaaaaatattagaaagcgttttcgcaaatctcgcagcgggattcagcttttcttttgccgcatcctgatgatttacgtgttcttcacgctcgatatcagcttctttagaaaaggcatcgaatactttattcacaaggcctgttccgaaaatgatctggtactggccagagctgctgaaagcccctttgacgccatcaagctcttctacttgtgcttgatctatctttgattcatctttcatcactaaacgcagtcttgttgcacaatgagccgcgctgataatattttctttccctccgagaagctcaatgaggcgttttgcagtctctttgtaatccatctatttctcccccttttatttaaacaaaaaagacctaaaattcgccaacgaataaaggacacagcgatcctttttcatttacgcaaattttaggtcttgcctgctttaccagtcacaatcccgcttattcagattaagaatacgctttcatcataaatcatgacagcgttttcgtcaactatttttttagttaaatagtttgataaaacatgtagacaaaaattcgtaaaaattaattgtgaaatacttcacaatatcgtgctatactatgctcaatcatgaaagaaagcaggaaaagacaatggaaactcaagcattgcaaaaggttgaacagtatgctttgaaaaaacaaaacatattcgcttcaagcaaaatccgttatgtgcttcggtccattttggccagtatgtttattggttttggcattacagccgcaagcaaaacaggcagctatttctttatggctgattctccgtttgcctttccggcagccgctgtcactttcggggccgctattctgctgattgcttacggaggcggagatttatttaccggcaacaccttttatttcacctataccgcgctccggaaaaaactcagctggcgcaacaccctgtacttgtggatgtcaagctatgccggcaatttaatcggcgccattctgtttgccatcctgatcagcgcgacgggactttttgaggagccttctgttcattcctttttgattcatttggcagagcacaaaatggagccgccggcttccgaattgtttttcagaggaatgctgtgcaattggcttgtgtgcctcgcctttttcattccaatgtctctcaaaggggaaggagcaaagctttttaccatgatgcttttcgttttctgcttctttatttccggctttgaacacagcattgccaatatgtgcacattcgccatctcgcttttgatcgagcaccctgatacagtgacactgatgggagcagtcagaaacttaatccccgttacgctcggcaatctgaccgcgggaatagttatgatgggctggatgtactacacactgaatcctgatcaataaaaaaacttccagagatcactccctgcaagtcaaagcggttattccgagagatcttgaagacgctggacatgcagcgtgatatagccggcctcggattccggcaaatgtaattgatattcatttttcaaaaactccgccagctccagcgcacattgataggcgaatgaatactttttttggatgaaataaagcatctcctcgtccatacgatggagcgcttcatttgattccaaccggctgaccgcgtatcgcaaatgcgtgacaaggcgttgataggaaatgctgttttcatccacctttcgattaaagtattgttctattttctctatcatttctttgatcatggtcgtatgcttcagcgctgaatacatgctctccgcatccatcttcgccgtatggatgtgaagggcaatataacccgcttcatcttcaggcagagacacgcccaatgtctcttttacatgtccgatcgcccacaggccgatctcgtattcttttttatagagcgcctttatctcatgcagcaatttattctgcacaagcaacccattttgaatcctttcgatcgcaaaggacaaatggtcggaaagcgcgatatgaatgtgatcgctcagcggcgccgcgagctctccttccgcatagctgatgatatcctcagctatttctacatgctcctccggcagtgtttgcaggatttgtttgaacttttcattctcgtcgcgcacgacaaagattttttccactttattcatagggatgagatcatttttctttttttgaaaagcgattcccggccccatcacgattttttcctgatcatcctcttttattaaagccgcattgttgtttaatactttatagattttcaagaggttatctctcccgccaatttgcttttgactgggattttacctccttttgaccgccatgtaaagatgcgggcccgctctctcctgctttggcgattccttgaaggcttgcaaacatcttcttttataaagcgcggcggctttcgctttctgcttttcttcctcattcacagccatccgccactcataaaacgaaacgagtcctgcggcctgcacagccgcctttctttggtatgtacgctgagccgaatagaccgcggcagccgcagtttttctgtccggcgtcacccagttcatcaaaaagaccatccacacccgtaaagatacaagcaaacgtttcatagaaaaacatccctccgcttctttttggcaggcagcctttttagcagcccgttttctcagccgcagcccgcaagaaaagacggccgatttcttttctcgcaaactagcggctctagcaaaactcatgactctatgatagaccgtggaaagagaattctttgtcacaatatgagtgaaaaaaccaactagtttttagaagttttgttgaaagctgaaagaattgaaatgaaaattggagaaccgctttgaaaactttatacacaagttatcccaaagataagaacaacttaatcacaagagatatccacatgtccacaaactctatctatattttgtatacgaacgtatattcctaactatatatatacacaggtttattcacttatacacagggttctgtgtataactccttcgttatacacaaacaaactccaataaatggtccaaatgacacaaggatttttttgaattttcaagaaatatatactagatctttcacattttttctaaatacaaagggggaaacacattgaaaaaggggatcattcgctttctgcttgtaagtttcgtcttattttttgcgttatccacaggtattacgggcgtccaggcagctccggcttcttcaaaaacgtcggctgatctggaaaaagccgaggtattcggtgatatcgacatgacgacaagcaaaaaaacaaccgttatagtggaattaaaagaaaaatccttggcagaagcgaaggaagcgggagaaagccaatcgaaaagcaagctgaaaaccgctcgcaccaaagcaaaaaataaagcaatcaaagcggtgaaaaacggaaaagtaaaccgggaatatgagcaggtattctcaggcttctctatgaagcttccagctaatgagattccaaaacttctcgcggtaaaagacgttaaggcggtgtacccgaacgtcacatataaaacagacaatatgaaggataaagacgtcacaatctccgaagacgccgtatctccgcaaatggatgacagtgcgccttatatcggagcaaacgatgcatgggatttaggctacacaggaaaaggcattaaggtggcgattattgacactggggttgaatacaatcacccagatctgaagaaaaactttggacaatataaaggatacgattttgtggacaatgattacgatccaaaagaaacaccaaccggcgatccgaggggcgaggcaactgaccatggcacacacgtagccggaactgtggctgcaaacggaacaattaaaggcgtagcgcctgatgccacacttcttgcttatcgtgtgttagggcctggcggaagcggcacaacggaaaacgtcatcgcgggcgtggaacgtgcagtgcaggacggggcagatgtgatgaacctgtctctcggaaactctttaaacaacccggactgggcgacaagcacagcgcttgactgggccatgtcagaaggcgttgtcgctgttacctcaaacggcaacagcggaccgaacggctggacagtcggatcgccgggcacatcaagagaagcgatttctgtcggtgcgactcagctgccgctcaatgaatacgccgtcactttcggctcctattcttcagcaaaagtgatgggctataacaaagaggacgacgtcaaagcgctcaataacaaagaagttgagcttgtcgaagcgggaatcggcgaagaaaaggattttcaagggaaagacctgacaggcaaagtcgccgttgtcaaacgaggtagcattgcatttgtggataaagcggataacgctaaaaaagccggtgcaatcggcatggttgtgtataacaacctctctggagaaattgaagccaatgtgccaggcatgtctgtcccaacgattaagctttcattagaagacggcgaaaaactcgtcagcgccctgaaagctggtgagacaaaaacaacattcaagttgacggtctcaaaagcgctcggtgaacaagtggctgatttctcatcacgcggccctgttatggatacgtggatgattaagcctgatatttccgcgccaggggtcaatatcgtgagcacgatcccaacacacgatcctgaccatccatacggctacggatcaaaacaaggaacaagcatggcatcgcctcatattgccggagcggttgccgttattaaacaagccaagccaaagtggagcgttgaacagattaaaaccgccatcatgaataccgctgtcactttaaaggatagcgatggggaagtatatccgcataacgctcaaggcgcaggcagcgcaagaatcatgaacgcaatcaaagcagattcgctcgtctcacctggaagctattcatacggcacgttcttgaaggaaaacggaaacgaaacgaaaaaagaaacgtttacgattgaaaatcaatcttccattagaaaatcatacacactggaatactcatttaatggcagcggcatctccacatccggcacaagccgtgttgtgattccggcacatcaaaccgggaaagccactgcaaaagtaaaggtcaatacgaagaaaacaaaagctggcacctatgaaggaacggttatcgtcagagaaggcggaaaaacggtcgctaaggtacctacattgctgattgtgaaagagcccgattatccgagagtcacatctgtctctgtcagcgaagggtctgtacaaggtacctatcaaattgaaacctaccttcctgcgggagcggaagagctagcgttcctcgtctatgacagcaaccttgatttcgcaggccaagccggcatttataaaaaccaagataaaggttaccagtactttgactgggacggcacgattaatggcggaaccaaacttccggccggagagtattacttgctcgcatatgccggaaacaaaggcaagtcaagccaggttttgaccgaagaacctttcactgttgaataagaaaaagccctgccgaatcggcagggctttttaaagatcagtcagcaaacgcctcctgcaataatcgatacgatcggagcttatcttcaaaatgatgtgtgatggtcaccaccatgatttcctctgtttcatacgctttactcaaagctagcagccgctccttaacctgttctttcgtaccgacaatcattcgatttcgattatcagcaattcgtctctgttcataaggagaatacgtatttttccgaacagcttcatacgaaggaactccctctaaaggaataccctgctctcccgccaaaagtgtaaaatcaagcacagccccaagctcctctgccttctcctccgtgtcagcacaaagaacaaaaacagcaactgccgctcgaggcgtatctcctaacacagacggtttgaatcgtctcttatactgtctgacagtaccctctccgccctctccattgataaaatgggcaaacatatagccagcgccagattcagctgcgagcagcgcgctttctccagatgagccgagcagccacacatccggagccgttgaaatatgcggcgcagccgtcagattcggaaaacggtgtttatcatccgccaaatcatgcaaatacatggtcagctccttgatttgctgcgtatactgatcagcattgcgcttaccgccgtcattcagcgcccatgatgcaatcggcattccccccggtgctctgccaagccccaggtcaattcttcctggtgtcagcccctccagaacacgaaagttttcagctactttataagcactgtaatgcggcagcatgactcctcctgatccaacacggattcgctttgttttcgccgctatatgactgattagcacctcaggactggaccctgccagccgttttgaaaagtgatgctcagaaacccaaaatctcttatatccaaggtcctcagcagcttgggcaagcgcaacggtttgctgtaaggccgtttctgcattgctgccctctgatactggagattgatctaatatacttaatgaaaccatccctaccacctcatcctcatcgtatcactgatcttctactttttctccaaagccgctcacattgcttatcagtgtcccctatcattcgccatttatttgtgaaagcctgtccctatttgtcggaatatgttacacgtgaaacataaaaacccctccagacggagaggtttgctttagtttttattaaagcccttttctttcacgtagtcatttaaatacgtacgcggcttttgcttcataaagttcagtatttgatcggaccacgtttcttcccgctgcccgtttgttctttctctatagtaatcagaaatggttttgtcatacgtattcatagtatgacggaaatcgtctgtgttcacattatacgtattctcatgataaacggcctgctttggcaatctcggttttttgccggaaaggttcgcaggatggcctactgccagtccgaaaagcgggagcacatggtcaggcgtttgcagcacctctgtcaccttgtccagttcattccgaatgccgccgatatagcaaatgccaagccccatggattcagcggcaatgctcatattttgcgctgccagcgccgcatcaatcaagctaaccataaacatttctgtattctcgagcagctcagaaatatgttcacctttttcctcagccagtttttgatggcggtacaaatccgcacaaaatacaaaaaagtgtccgttcttctcaacgtaaggctgattcccagcaagcacggacagctcacgttttttctcaggatcagaaaccccgataatcgaatatgcctgcacatagctggatgtagacgcagcctgcgcacttttcactaatgtatcaatttcttcagctgtcaaaagctgatcagtaaaagaccggattgaccgatgattcaaaatggtttcgattgtgttattcatcacaaaaacctccttatcactttttatcatatccgaaaaaaagtgatctcaaaagcgaaatgctctgcacaaaaaaagacagcctctgtaaaggctgtctgcatattaagaattaaaaagataacttctgtatttcgtcagctgcacacttgcattatatacaatcccaaatccgattaacgtggaaagtgtcgagcttcccccatagctgacaaacagcaacggaatcccggtaacaggcataatgccgatgttcattccgatattctggaatgtgtggatcacaattaacgccgtatagccaacgcaaaagaaagaagcgaaacggttaaacggatgtattttgtctatcagaacaacaagcctgtagattaaaaagaagaacatgatgacaacaattgcacagcctataaagccaaatgactcacctattatagaaaagataaagtcagtcgtactctctggaacataaaccttcaaattagaaataccattacctaaaataccaccagatcctattgccatgatggcctggtcaacttgccagctgtcatttgaatcttcctgtgtctcatttgaagcagacacccaagaagtgacccgcttaatttgataatcctgtattccaactgatttagcaacgtcaggaaagtttatcattactaataaaattaatgaaatgagtaagatacctgaaccagctatgatcgcaatcaatttccaatttatacctgacataaaaaccattacaagaacgataaacatacatattcccgcagtcccagcatcctgcatcaagataagacctacaggaataactgcgacacccgcaatctttaataacaagtggatatcatccctaagcgtccgaactcctttaggattagcttttccaataactgaagcaagcatcataatcaaaccaaccttcataaactctgacggctgtattgttattctaccgatcctaaaccaactttttgcccctttaataacaggtgcaatagactcgggactgattttaagaataatcaaagataaaataccaatgataaaaatatataaacttaacttttcaagctgttctaaatcaaagtacaaaagaactgtaatggcaacagcccccaaaaaataaaacacaatttgctgaatccaatccgtgttcccatactgcccaaactgaccggcagcataaattgatactacgcttataataaaaaacacaccaaatataaaaatcaaatccccctggtaaaaggggctttgctgtttcttatatcgactcattctatcccgccttacattttcatcggaaaatcactaatgtttattatacatgaaccacgttcaagatgacacgtgaagctcgcttccttttatgttttttcagcatttgcggcgctttttcagctacacgaaatatgacgtatcataaaccgaaatgtttcgattgacacaaaacttttcaaatgaaaaaaacgccataccaaaagaatttgttaaaaaacgaatgcgataatgtgttatattcccaaataatgtgatacctcataagaaacagctaaaaattcagagccccatgcccatacattctcctagcacattaaacgaaaaaataagacgatagatccagtccatttctgcaaaaacacgtatcaatttctggaaaacatggtataataattgtaacagaatattcaaaaaacaatcacaaaacagacacaactcagttcctctatttcatttttgtaaacgttatcacaaaatgaaaggagacgggtatgatggacatgttttttgcttacttattggttgccagcgcaacgcctctctttatttggcttgataacaaaaaagtcgcactctcagctattccgccaatcattttaatgtgggtattcttcttcttttacgcaacagaaagcctttctccacttggacacactctcatgattatcttgtttgccgttaacgtcattgtcgctcatatcgccgcatttatcatttacggccttccgtatcttcgcagaaagcgaagcagctgaagacagcaaaaaaccctcttccaatgaagagggtttttgtattattcgttatggcctgaatgctctgagtgttcagcgcctccaggaggatttccgtccatatggtcaccatggtgatagtgagccgcgaaaatccagatggatccaagtacgataacgatcgcgccaaagaatccgaacagcgtgtttccgacttggatcgtgccgttttcgctctctgtcatatgcatgaacatgagaagctgcagcgccgcctgaatgaaggcgaagccgaagataatccaaagttttgctgatgagctcaggtcagtatacactgcaacccatagagccagcagggtcaaaacgatagacaggataaaacctacaatgtgtttccatggaaagtgactgtgttcagcagatttgtttgccattttacagacccccaatcccatgagatagacacctgtaaagatgaaaatccatacaacatctaagaagtgccagtacaagcttgagataaagattttagatgaagtttgcggagttaagccgcgtttcttcaactgaatcagaattcctgtgatccagaaaatcccgattgttacgtgagttccgtgagttccaagtaaaacaaagaatccagaccagaacgcacttgtactgagagccgctccttcatgtacatagtgaacaaactcgttgatctcgcatccgacgaagccggcaccgagaagaagagtgataattgtccaaatgactacgccttttaaacttccgcggcgcatttcatgaacagcgatcccgcaggtaaagctgctgatcagcagcaagaacgtcataatcattaccagattgacttcaaatagttcgtctggcaagacacctccagctgttctgtttttaagaacgaagaaggttgcaaatagtgttgagaacaacacaatttctgcccctaaaaagatccaaaacccgagaatattaagtctgccggtttcagattgatattccataggcgcgttagaattgccgtgttctgcatgttccataactcacgcctccttattcggaaatctttctttccgtctcttttatttcatcaacactaatgtagtagccgttgtcgtattcgaatgaacgcagaaccatgcagagcaggactccgatcaatccgactacgcccatccagtaccattcaaagacaagtccaaagcctgcaagaccgaaggcaacagacataaagaacggtctgcctgagttgcttggcatatggattttcttgaatttgctttcagggtataattcagttttttcttctttcatatgcaggaatgcatcttgagatttgacttcaggaagcaccgcaaagttgtaatgcggcggaatcgcagaagaagtcgcccaatcaagcgtacgtcccacaccccatgaatctccgctgatttcacgagtagagtaacggaagctgtagtagatgttatagcaaaggattaagaatcctacacccatcatgaaagctccgactgttgagataaagttcaatgttgtccagccgtcattcggtccgtatgtgtaaatacggcgaggcatgccttgaagccccaagaaatattgcgggaagaaacaaatattgaacccgatcataaagatccagaagaaccattttccgattctttcgttcagcttgtggccgaacatttttggataccagaaaataaatccggcgaaacaagcaaatacagtacccgcgatcagcacatagtggaagtgagatacaaggaagtacgtattatggtattgataatccgctgctgccatcgcaagcataacccctgtaaccccgccgataacgaagttaggaatgaacgcaagcgcccacagcataggtgttgtaaagctgattcggcctttatacattgtaaagagccagttaaagattttaaccccggttgggattgagattgccattgtcgtaattgagaagaatgagttaacggacgcactgttccccattgtgaagaagtggtgagtccaaactaagaaactcaatacagagatggcgataatagaaccaaccatcgctttgtaaccaaacaattgttttcttgcaaagcttgagatgatttctgagaaaataccaaacgccggaagaataacgatatatacttcaggatgtccccaaatccagaacaagttagcccaaagcatcggcataccgcctgcttccaatgtgaaaaagtgagcgccgaacaaacgatcaaatgataaaagtgctaatgctactgtaagtacagggaaagcaaacacgataataaccattgtgatcagtgttgtccatgtgaacattggcatacgcattaatgtcatgccttttgttctcatttttaagattgttaccataaagttgatccctgtcatcagggtaccgataccggcaatctgaagtccgaggaggtagtagttctcacccggcccagggctcatgtcgttacttgcaagcggcatataactcgtccagcctgcgttcggagaacctccgataacgaaagaaatattgaaaagcatcgcccctacaaagaacgtccagaagctcaggttgttcaagtaagggaacgcaacgtcgcgggcaccgatttgaagaggcacaacaacgttaataagaccgattaagaacggcatcgccatgaagatgatcatgattgtaccgtgagttgtaaaaatttcattatagtggtttgagtctaaaaaactgttattcggaagcgctagctgggcacgcatcatcagaccgtcgacaccgccgcggaataacataattacagcagatataatgtacatgattccgagttttttatggtcaacagtagttatccattcagaccacagccatttccactttttgaagtaagtcagtacaaaaataatggcaatggttgaaagcgcaatggaaacttgtgcgcccagaattaatgggtcaccagttacgaaaaattcgtcccatttgaatttcatgcaggcttcctcctttcctgatcaatatcattcttctgtatcatcagacttcttaaattcgtttttctttacgttttcaaacggatctgttttagagtgcggtgaaacggcttgatagccaaggcgtttgcgcgcctccatcgcgtactcagcgtcttgtccgtgatcaacgtatttcaagtgagtagaagagaacgttaattcgtccacattttcaggaagcatcaattcatcatacttctcttttgtcagcttaggagcctcgttctgagtctttttcacccagctgttaaagtctttttctgtaactgcattcacatcaaactcttggtctgcaaaatgttcacctgtgaagttcgcgttgcggccttcgtaagtacccactttgtcagcctgtaagtattgatccatcagcattcctgccatcgcatatttttgccctccaagctgaggaatccatagcgaagccattgaatctgcagatgagattttgaacaagatcgggcggtcgacaggaatgtttaagtagttgaccgtttcaatatcctgttcagggtagctgaatacccatttccagtctaccgaagtagcataaacaacaagaggctctttatcttttgttgcttcaggagctttttctaacgaatatatcgtctgtactgttggcacagaaagtgcaatgacgattaaaattgggatcactgtccagactacttctaaaaacgtgttaccgtgaatttctgggttataagatccattatctttgcctttacggtcgcggtattttactaaaataatggtaaatagaacaaagacgaccccgacgataaacagcataaatccgatagataacaggattaaatcactttgctgttcagctacaggtcctttcggatctagtactgaagcattgctgcatcccccaaggacgaaaaccacagttaacagcgctaatacaagcaacggttttaatgctctgaacaagaagatcaccatccttcctattgatgtaataaatctgaagtgcatacttcctcaaaatcttttctctactttgttatgctatcaaaaacttcacttattagctttatttttttataaacttcatcccattttcgcttaaatgtcataaaatcgacaaaaattgctccaactttattcacatctatcgcttaagatgaaaagtttctagttatttccgcatataagtaaagaaaagatgatgaagaactaattctgacaaataaaggtttaccacaataaaaaacttaggtcaatcaaaaatttcattttgttaaactttctagataggaattattttttccttgtctagcatcttttcacacggttaccattttaacgcatcaaatattgaaagaaaaggcgcaatgaagagccaatatgctctgaattgtccgtattttttaatgagagcatccagttgtttatcttatacaaaaaagaggaatgatataagcaaataaataaaaaataggatgtgttgcatgatgagttttcttatttcacttatcgtcgctattattatcggatggcttggaagcctgtttgtaaaaggagatatgcccggaggaattatcgggtctatgatcgcaggtcttattggcgcctggatcggacacgggctgcttggaacatgggggccgcacctagccggatttgccattattccagcggtaatcggtgcagccattgttgtctttctagtaagcctgttaaccagaaaaagaggataaaagcagcagcacccgaagcgtcagcgctttgggtgtttgttttgccataaaaatcgaaaaagcctcaaccctagcggttgaggcttttgactggtttggcgcccaactggtcgataaaccttctgaaggcctgttttccttctgttgtctgtttaaacacaccggcgtgttcaaggatgcgcgcgaatacatgtcccagctcttcttttatgactagatctgcattctcttttgttatggttcttttttccatcatccgattagcccactcactatgttttgccgtgagcggattttgttctaaagctgttttcggatcagcagagcatagcgccgctgccgtttctttcatttcctcctgtaagcggcccggcaatatcgccaatcccatgacctcaatcaggccgatattttcttttttaatatggtgaacttccttatggggatgaaatatccctaatggatgctcctcatccgtccggttgttcctcagtacgatatcgagttcatacaagcctcccctgcgccgtgcaatcggtgtgaccgtattatggggcgtatcgcctgtataggcggcaatgccggctttttcatcggaatacgtctgccacgtgcggaagatatggtcagcagcttcggcgacatgacccggttcgtctccttggagcctgagcacagacatcggccacttcactaagcccagcgacacgccgggataatcgtttaattcataaacgtcttccgcttctgcacgtgccattggaaaatcatgcgcgccgccttggaaatgatcatggcttaggatgctgccgccgacaatcggcagatccgcgtttgaaccgataaaataatgcggatattggccaagaaatgacagcagcctttcaaatgtttttttgctgatctccatcggttcatgttcaccttttaagacaatgcagtgctccggataatagacatatggcgagaattgcaggaaccattgttcgtcctcaaggatgaccggaatgattctgtgattttgccgggctggatgattcacgcttccctcgaagccgacattttctttacacagcaaacacatcggataatttgtctgttcctgctcttttgcagccgcaatcgctttcgggtccttttcaggctttgataggttaatggtcatttccagctcgccatattcggtcggcaccgtccaatgaacatttttggcgattctgtcagtccgtatataatagacatcctctgaatattgatagaattcctttgtcgcctgttttgggccgtataatgcttttgtctcttcaaatttgcgaatgacctcggacggggcaggcacaaaacagcccatcagctttgcgctgagcaggtcacggtacgtatctgtatccgcttccattcggccggtttcggcagcccatttatagatgggagctagcaagtccggcaggctttgtgactgcttgatgctggtgctggagttcggctcgggatgtgtgatgcccagcgcttcataaagacggtttctcgtatattcccgatcccagatcgaaatcaattttcgttccaggccatactcaagcagctgttccagatgttcaataatactcatatgtcactccccctttagttctctcgctccctctccgatatccgcgacataaaagtccgctcggagccctgttttttcttgatatctgtctccaaccttctgaataaaatcatcaacgaactcatcttttacaatgctgatggtgcagccgccaaagcctgctcccgtcattcttgatcctattacaccttcgtgatcccatgccgcaaacacaagctcatcaagttcagggcatgttacttcatagtcatccttcaatgagaggtgggattccttcattaactgcccaatttcatctatattgttctctttgaacatatgggccgtcttaatagcacgatgattttcgtatacagcgtgctttgcccggcgtctgttcgtttcattttggatcaggctggaatgcgcatcgaaatcagaaggcttgatgtcgcccagtgcggcaatatcgaggccttttttcagatcaagcaatgcatcattgcattcttggcgtctcgtattatagctcgagtcagccaatgtcctttttttgttcgtgttcgcgatgaccagcgcgaggcctgagacattgagtttgctatattcatagtcaagcgtgtcacagttcagcagcatcgcatgatgttttttccccattccaattgcaaattggtccataattccgcaattgacgccgataaaatcgttttccgcatgctgcgccattttcacaagctcaagcgcatctacttcaggatgaaaatagctttggagcacgacccccatcagcagttcaatagaagcggaagacgacagccccgccccgtttggaatattccctgaaaatacaatgtcaaagccatagggaactgcatatcccctctgttgaaattcataaatcacgccttttgggtagttcgcccagtcgtcttctttttgatagcgaatgtcgtcaaggctgcattccttgatcccctcgtctttaaagttgtctgaatacatccgaacaagcccgtcttttctttctgcaacagcagcatatgtacccattgtcagcgcgcacggaaagacatgcccgccgttatagtctgtatgttctccaatcagattcactcttccaggtgcgaaaaaaaaccgtaatccctctttttctccgaatacacttgcaaatatcccctttagctcttcccgcatgtgcaatcacctttctggtttttattttttattccccttatttctccatagaaaacggcagatcatatgctgcagtcctctcataccccttcttcttttgtttttttaaagacgagccatttgctcgcaacatagttgacgacaacaatgaccgcgttgtcgagtattttggccaaggtttcatttgtattgaactggccgacaagaatgatcatcatgcctaaatctatgccgagagacaggacccgaacgctgaaaaaagcagtgagctctttcagcaggctctgcagatcatgtgttttttgctgaaacacatataatttatttgttatgtaagcaaacagcacggacaaaatccaagcggcgacagtggcggctttgtaatccacattcatgatctctaccaatatataaaagctggcgatattcacaatggttgtgaaaacccccataatgatatacataattatttctctatacttcactgatgttcctcgctttctgaaaaacttttcaaaattcttggcctctcgtgctctctgtctaaagtaaaaaataccgaaagtgcgtctaaaaagctgcggaaggtggctggctggcccaatacatatgattgtttgatgattccgtcgaggactgcacatattattttagccgtatattcaggatcaatacaggcgtcaatcagctttctctccttcagccacttaatatataacacattttcttccacccacaattcgtacagccggacataggccttgcatttctttaagactttatatgtcggcatgttcatggcaaacgaggtgatgtcccacgacggcttatttatgtaataggaataaagcagttctgcagcgtgttttgcagcctcgtccaatgtcagcgatttcactgactcccgctccatttgatcaagataccctataatgatcttttttttcatctgacgtttttcgagaaggtacagcagaaaatcgtccttgctgacaaaatgaacataaaatgctcctttgctgtacccggcggctctgctgatatcttctacagaaaccggatcatacgctcggtcaatcaacaaattcacgccagcgtctataaaactttcaaatgttgcttctcttttaatttgaaatttgttttttttcatatttttctcctggcggtaatgattacccttatcttacaccggatcaatctttagcggtatttatttctttgaacggttatgctattcggtttcccaggggtcatttttaataggctaaatgatttattttcatttacatactatccagtcagtatttaattgtttattattataaataaggtccattggttatattagtcatttttttagggaataggtaggtggtttttccttcagtttgtgaacaccgagcaactatgtgtgaaatttgttgtactcgcctcatcatcgcgctggcttgtcttttattgcccgcatgttgcaggaaaacattttatacaattggaggttactatgaaaactcatgttaaaaaagatttggacaaaggttggcatatgttaattcaagaagctagatccattggattaggcattcatgatgtgaggcagtttttagaatctgagacagcatcgagaaagaaaaaccacaaaaaaaccgtccggcaagactagtccgaacaggcggatctatttacctctggcttttctatcacctgatctgagttttcaccatatcctctattcaaaagcaaatcgctgcgctgagcttgaggacaaacggtgtgtcagctaactacgacagacagccggtgatgcgatcacctcttggcacatgcattgtcataaagaggtgatgcgaacatgataaccgtgctctggtaaacagcagctttgctgagaacaagctgcattcggtgaggttttgaaagcaaactcgtttatacacggccgagcttgaaaaccttcgcctgtctttagaccactgtgttcacctcttcacgacttccttcttttttcatcctccagatattgttcaacgcataaatcggactttcagtacatacctattggtgtacctttttgcttacgtttagcgaataaaaggaggaaagccatgtacaaagctgattataaacagattgctgcaacgccgtcttttcaagcttttttaaagcagaaacgcgcttttattgttccttctgcgattttcttttttgtcttttatttttcactccctgttttgacatcttatttcacctttttgaatgcaccggccattggagctgtttcatgggcttggctgttcgccatcgcccaattcgctatgacctggatactgagtactgtgtattcccggagagccgctcatttcgatcagtatgtaagcgctttaaaagagggtctgaagggtgaacagacatgaatatgactgcttttttattatttttggcgattgttggcctgacgcttattatcacgtattttgccgcgaagcggacgaaaacgacgagtgagttttatacggcgggcggcgggctcaccggcgttcagaatggactggcaattgccggtgactacatgtctgccgcctcgtttctcgggattgccggaatgattgcgttatatggatttgatggcttcttttacagcatcggttttctggtggcttatctcgttgtcttgtacatcgtggcggagccgcttcggaatcttggaaagtacacgatggcagacatgattgccgctcgctttaaagaaaagaaaatccgcggtgtcgcggctctcaataccattgccatctctactttttatatgatcgcccagctcgtgggggcgggcgcgctgatcaaactgcttctagggcttgattatactatggctgtcctcatcgtcggagtgctgatgaccatttatgtcgtgtttggcggcatgatcgcgacaagctgggttcaaattattaaagccgttttgctgatggccggcacactcgtgatttcgattatcgtgttttcgaaattcggctttagcctcaataccatgtttgaacagatgaaaacggctactccgctgggcgctgattttttgaaccccggaaataaatacaaggtgccgcttgagaccttgtcgttaaacttggcactcgtgctgggaaccgccgggcttccgcatatattgatccggttttataccgttaaggatgccaagacggcccgtacatccgttgtgtcagcgacatggattatcggtgtgttttacattatgacggtatttctcggctttggtgccgcggcatttgtcggttttgacgcgattacggcggctgatcaagcgggaaatatggcggctccgcttttagcaaaagcgctcggaggagactttctgttcgcgtttgtatcagccatcgcctttgccaccattttggctgtcgtgacagggttggtgctgtctgccgcctcagcatttgcccatgatatttacagccagatcatcagaaagggagaagcaactgaaaaagaacaaatgaaagcggccagatgggcttctgtcgccgtgtcagtgctctcgattctccttgcgatttttgcacaatccttaaatgtggcgttccttgttgcactcgcgtttgcggtagccgccagcgcaaaccttccgctgattgtgtttacagtcttctggaaacgattcaatgcctcaggcgctttatcgggcagcctgacaggcctgatcagcgcgcttgtgctggtatcgatgagccctagtgtgtgggacccggctggaggtgctatttttaccggtgatccgctcattccgctgtctaatccaggaattatttccatcccgctcggctttctcggcgcgtggctcggaacggtgctgtcgtctgataaaacaattgatgaagatacgtttgcagaaattcaggtgaaggcgcatactggcgtccatatggaacaggaataaaaaaagctctctttatagagagctttttccttgtcttttcttctgttcttcagaaatcgctttttcaaatacatccttgccggcagcacctggaattacagtgtcgccaataataaaggttggaacggctgtgatgtcagcctcttcataggcgtgcttcaaggcttggcgctgcacgtcctgatatgttcttatttccagtgctgatttgaatgatgcaccgtctaatcccacttcctcggcgagcttcgtcaagatgtcaatgtcgccgatattttggccctcctggaaaaacgcctgaaagacacgggtgttgtattcatgtcctttatggtattccttcgcaaaatggaagccttcaaacgcgaggtctgtatacggatggggcgagacgtttggaaaattgatctcgacccctaatttctccgccattggctgaattgatgtctgccacatgtactgtttggaagggtcattgaccggatcaagctgaggagatgggcttggacgcagttcaaacggcatccactcgacttcaacatcctttccttttatcgcttcttcaaaagcggcttttccaacgaaacaaaatgggcagacgtaatctgaataaactttaatgtgtactgtcatgataatctcctttcgtataaattgattttaaactgtaacaattaaagttacaactgttttttaaataaagaagccgataaggcttcttttatgattccagcaaacgctgggcaatatattctccttttttgcagccgcctgggcatgcatataaagcagaaccgattgtttgtgtatattcgtttaacgcatcctttgctgaaagagccttcagcatcgggataaactgattgtcgggatttttttgaaaactgataaacagaagacctgcatccatatagccggttttcggatcaagtccttctgtgtaagagaaagctcttcgcaaaatttgttttccagtagatttcgctagactgacgtgtgaattagacggaatttgattcagcttcacgggatctgtttcctttttctgtccgaaaggcgcccccgagctttttctgcggccgaaggtatcctcttggtccttgagggaagagcggtcccatatctcaaggaacattttgattttccgaaaagccatataggtgccgcccgtcatccagtcaggctcaccagactgaatccacacgatcgagttcatcaagctgtcatcctccgtgctctggttgcctgttccatctttgaacccgaagaggttgcgcggtgtttcaccattttttcctccgcttaaaaagcctttgttcacaaagcggacctcacaagtgccgaccgcttgatttagcaggttacgcagcgcgtgaaacgccacttgctcgtcgtctgcacacacttgaatgcagatgtccccgcctccctgcttttcatccaggttgtcattgggcatcgctggaagagcggctaggtgcttcggttttttgcttttcagcccgaaacggtcctttccgtctttttcaaaaaagccaggcccaaatccgaatgtgaccgttaagttggaaggggataaatcagcagactcacctgtatcctgcggcggcagatattgatttctctgctccgctgacattttcttgccagacgtcagcatctgtgtgagacttgtccagtttctaaataacgtaatgatgtcgcttttgtcttttgctgttacatccagtgcagcaaaatagacatacgtctgatgggcagttgtgattccggcctgatgctttccgtaaaacggaacaatctgctcctcctctttttcatcctttttcgatggcttagccgcagtctgaacaagtggagcgagaccgccgagtccgctggcaccgatcgcaacggctgcccccgccattgcccccattttaaaatgtcccgtctgtgaatttgttctgactttttttgttcatcgctcatgctgttacaaaactccttttatagcacattcgcaatcttcgacatggtttcagaaagagtcgtcagctttgtgctcagctctctgatttgcttttcacttaatttatcataagacgtataggactgatcatttgttttgtattttgccattaaaacttcaaattcgctgaactccgtatccagtttttccgtcaagtcggagtgatcttttacaagcgcgcttttcactgtttgataaacggcttcggagccttccacatttgccataaggtcgactaaatcgattcgtgagtagcgctcttcttctcccgtgattttcgaaatcccggcttcgttcagaagctccatcgcgcctgctacaatttgttcaggtgttaatttcagtgattgaattgaaccgtcaagctcttttacatccttgagaagctggtcagctgttgccttttccccggaaatatcttgatccttccaaatggccttctcaagcttatggaagcctgtccatttgtctccttcttcaacatcgttttctcgagcatcaattttcggatcaagatctccgaggctttcagcgatcggttcgattcgctcgtaataaacacgcgctttcgcatataacgttttggacttttcgatatcgccggatttcacagcacccgtaaatgcttcagtcgctttgacaagctggtcactctgctctttgacatagcctttatactcatccgctgcttttgccagctgatcgctagcctttttgccgctcttcttcgcttctgtcaggtcttctaaggacgctttcagtgactcggattctgtcttgatttttgctgtatccggtttgtctttttgcgcttctgtgtagattggctgaagatgcttttcgatttctgtatattcgaatggatagtcgctgcgaatatcgttttcaaaggaaagccagtagctgtttaactctttccccttcttttcaatctctttttggtctcctttttccgctgagtcattcagcttagaaatgatggtttccattttatttacggatgcggtgatttctttagtgatcccgcttttttcagatgaagctttttctttagttgaagatgtgtcgttggctccgcagcctgcgcacagcgcaaggatgcatccggctgatacagcgatttttgtgaaattcattttgtcagttcctttccgtttgtaaaatgttttgccgcttctgaaacaagcgcaatcagtaaaaagaggaaaatcaacatttgcggaatcgtgctgtacacagacggataaattcctagcaccgatacagacggcagccagctttctgcatcagacggaagaatgcccgccagttgaaggctgtgaacgccggttccgagaaatttcacgcacatatacaggacaaccgccattgatagaagaaaaaacggcttcaatggaatgcgcattccgagcttgatcatcagaacaccgacgatgacgagaacgataagccctgcggcagttccgccgatcagttcagtgagcgggagcttcccgacaagcccgatgaaaaagatgaccgtttcgagaccttctcttacaactgccagaaatgcaatgagcgcaaaggaaagcaggcttcgtttttttagtgcctgtgacttctggatattgattttttctctccatttatccattgaggcgtttctgtgcaaccacaccccgacatacaaaagcatgacagcggacagtacgccggtgacgccgccaagcaagaaattgttttctccgaatacactggaggagaacagaaccgtgacaccgatgccggctgctaaggaaacagccatgccggcagacgctccgccccagatccatgccgaggagcgcgtgacccgcgctttttttgtcatggttaatagtgctccgatgacaaggagggcctccatcccttcacgaatcgggatcagcgccgcatcccaccagctgtagctgcttgaagcgatcggctcgagcaattgaatcatttcgtcaatttgctttgataccttttcgggatggctgccgatctccgccttcatcagtgccagattttcctccgatgtcgtataggcttctttcgattgggacacgacgtctccctctacggcgagccaggatgtaactaaattgtcgattgcggatgacgcttcatccaattgttttttttctatgaactgttttgtgtctttcaagctttgtatataggctgttaaggacgcccttgattgacctgaggatgtctttttcagcacgacagcctgctgataggtttctaaatgagacgcaagctcttcaagctgtgttttgagcttgcctgcgtcttgattgataaaagaaagagaaatcatcgcgatattcgcgtccatttcactgtgagaagaaaggttttctttcttaatagaaggttcttcttttttccacttcgctttgaaggtttcaaacgtttgttgtgccgaatccatatccccgtcttttacggatttgatcatttgcttgtttaattgaattaatgcggcgatcggatcatcttccgcatgtgccgcagaaccgaaaaccatcaacaagctgaatagaataagtgccagcccccgagccatcatgttcctcctataattgaaaatgattatcattgtataacataatcatagccagttcttgtcctttgtcaattaaaatttgaaggtctgaaaaccttgatggacagcaaaaaagctgtccttttacagaacagccttttgaaggaagatgaacgattatctttctgttttatatgtttgaatttcctcacgaaacttgcgtgcagcactctcaggatcttccgcctgactgatggcgctgatcatactgacgccatcggcccccgcttggataacaggtgcggcattatctattgtgatgccaccgatgccgacaattggaatgctgatgccttggcggcgcactgcttcaataagagataccccttgtaccgctctcgtatcttttttcgtttcagtcggatagatcggcccaagcccgacataatcggctccgtcttcttcagcttgcttcacctcagacatcgtatgggcagaaacgccgagaatcatatcacctatggcagctcttacctctttcgcatttgcgtcttcctggccgatgtggataccgtcagctttcagcttcagagccaattccacatcatcattgacaatgaacggaataccagcttcacggcaagctgcctgcgctttttcagcaaattcaatccgagcctctcctgtcagcgcatccccgcctttttcacggaactggtacagggtggcaccgccttttaacgctttttgtacaactgtaacaggatcggctttcgtattgtttgaccccataatgaagtatacagataataactctttcatcatttcccgagaaatacgagtcatgagacagtcaccctttctatagccgcccattcttggacgtcttgttcagtaacagttgaaagcttgttcagcaattcaatctgaaagcttccagggcctttgtcagccgtctgctgtgcggcaagctgagcggcgaccccatacgaagtaatggccgcaatagcagcaaacaatggattttcttccacagcgcaaaacgcaccgacgacggaagtcagcaggcaaccggcgcctgtcacttttgtcagcagcttgtggccgttatgaagggtgtatacatgtgatgtgtcggcaatgacatcgacttcaccagtaatcgcaatgaccgtgtttagcttttgtgccgcttgctgagccagccggatgatgtcgcctccgccttcacccgcatcaacacctttgatcagccaatccgtcacaccgacggtatgggcaatttccgccgcatttcctctgattgcagcaaggcgaacctcacgaatgatgtcacgtgccgattcagttcggaacggtgttgctccggcaccgacaggatcaagaatgacgggaacgccatgttcattggctgatttccccgcgatgatcatcgcttcgactgactccttgctcagcgttccgatatttaaaacgagtgcacccgcaatcttcgccatatcggcgacctcttcttttgcgtacgccattacgggcgatgcgccgagcgcgagcaggccgtttgctgtgaaattcgttacgacattgttggttatgctatgcaccagtgggctgtgccggcggacagcagtaagacattttgctgctgattgtgcatccatgtttgcatcatcctttactatcttttttcgggtcccataaatacgatttcgtatgttcgagccaagctctggcggcaaacgacaagtaccggtcctttctccaaataatggcgaggtgccaagggatgaccggatcgacaagcggaatgactttcactttttccgggtcaaggccgcggcagatccgttccggcaaaagcccgatcccaaggtttgctgataccatctcactgataaaatcccattgtgatgtttcataaatgatatggggccggaacccagccttgatacattccgtcataattcggttgtgcaggacaaaatcctctctgaagaaaataaaaggctcgtccttcaactcacgcagctgacattctttctcatcagccagccggtgggaagggtgaacgacaagcattaaggtttcttttacgattgtaaacgaatgaaagatatcttcgtttgcgggaaggaccacaacgccgatatcaagagagccgtccccgacaccttcttggacttttatagaaccgtcttcgactagctgaaaggtgacattcggatagttttcacggaaatcgccgagcactctggggaaaaaccccgatccgatcatcggcggcagtccaatccgtacgtgccctttcttgacttccataatatcatttaattctgacgtcaggttttgaaatgatttaatgatttcctgcgcctgcacatacatgctatgaccggcatcagtcagttccacctgcctgccgtttcggtaaaacagttcaattccgagctcttcttctaaatttttgatcatttttgatatcgtcggctgagatacataaagggattgggaagccttcgtaaaactttttaaacgggcgacttccaagaaatatgttaaatggcggatatccatgtgcttcaccctttctatagacaaaaggaatacttcttattcttaatatatattttacctatagagagaccttatgtacaataagtatataagggaggcatcaatatgaaaaaactgttgctaaccgttattcaaatcgctctgttatttatatttgctcggctgattaattgggtgacagcccttcttcatataaatattcccggcagtataatagggattgtgattcttttcacattattgcactttaacattatcaagcttgaatggatcgagcttggtgcagcgtggcttctcggggagctgcttttattttttatcccgtctgccgtcggagtgattgaatacggagacattatgtcgaaatttggtgtcagcattctgcttgttgtcatcatcagcacgtttgtcgtgatggtgtctacaggaacgcttacacaactcattgcaaagagaaaggagaaaaagcatacgtgttcatcggaattgtaagtttgtttttaacggttttggtgtatttaggagcaaaaaaggtatatcaacgctttccgcgtgtttatacgtcgccgctattggtgacgcccgctgtgttagtcggtctgctgctgctggtgaatgtcccgtacgagtcctataatctcggcggcggattgctgaccgatatgctacagccggccaccgtggcattcgcgatcccgctatataaatatttccctgttttaaagaaatacgcagtggaaattattttgaatgtggccgtcggttcatgcatcgcgattatttctaccgctcttattgcgaaatggcttcacctcggcaccggcttaattgacagcctcgtcccgagatcagtgacaacgccgatcgcgatgaacgtatctgaaatgatcggcggaatgcctgccgtcacagccgtgtttgtgattttaaccgctttgctcggcacagtgatcggcccgatggtcatccgctatttccgtattgataacgaaatcgcgcggggcgtgctgctcggcacaagcgcacacggagcgggaacgtcaaaggcatttgagctcagctctgtgtccggcacgatttcaagcgtatcgatgatcttagctgcgattatgacgctttgcgcggcgccgtttttactttcatttatgtaaaaaactgtcctctcgagggcagttttttttatgtgcttccccttattgaaaagctcgcaaattacaatataatgtaatttgtggataccaaaggaggcaccctgatgcacaacttgcaggtgaggcggcattacgccgcgttaaaaggattttatttgtttgcttttctcggtacgggcagcatgattcccttactcagtatgtatttaacgaaggaacagcatttaagcggatcacaggtcggcttgatcatgtcactgggcccgattgtgatgattttctttcagccgttttggggcatgctcagcgactatacgcaaaaaacgaaaggcctgctggcggtttgcacatcaatcacaggcatcattggattagcctatattgcatttgacagtttccctctgtttattttgattgcggcctgttttgcagcctttcaaagcacgattattccactttcggacagcatttcactaaggtacacacaagaaacaaatggcaactacggcggaatccgcctgtttggttctctcggcttcggtgtcgcggtgtttgccatgggacaggtgacgaaccagctgtaccccattcacgtgatctttatctttggctgtgcctttctatgcattgctgccatattggcttcacaaatgcccggccagcagaaaacaacaacaaaagtcaatatccgcaaaggattccgggagcttatcagcaacaaaactttcctcatctttatgatcatcacctttacgacatttgctccaaacttagcgaacaatacgtatttcagtctttttctggacaaaagcggcgcgtcactttccgctatcggcattttatttttcatcggtgtcatttcagaaattccatttatgagattcgcccaaacatttatagataaaatggggctgctcaacgtcattatgctgtcaggcggagtctcattattcaggtgggcgctctatttcacggcgccttcactatggatcatttatgtgacggtctttcttcagggagtggccatcggtttatttatcccggcggcgcttcaatatgtgaaaaagattaccccaagacacgttgaagcgacagcactgaccatgtacgccgccatcggcaacgggttcggcaactggttctgcacatttgcaggcgggtatatttttgactacgtatcgattttcgcagtctacttgctttttggcattctgagcatagcaggctttggcctgacattatatttaatgaaggctgaaaaaaacaaacatacacttcatcagccggctgttacttttaaaccataatgactataatgaacaaaagaaaggatgtgcgttatgaacgggcaagagcgaaacagcatttcgaaagggttgcaggttgatattgtattgaaagcagatcaaaaaacaggaaaactgacgagagggacagtgaaggatattttgacgaaatcaagctttcatccgcatggcattaaagtccgtcttgaagatggccgcatcggccgcgtccagcagatcatttctacataaaaaaaagctgcccctgaacagggcagctttttcattattttttctgcagaaggaccactttcaggtagttgccttccggaaatgccgaaatcgttttgaaatcctccggcagcgtaaattcctcaatgatggtgtagcgttcgttcgtttctttaaaggcggcatcgataaagcctttgaatttcttcatgccaaaggcgctgctgtttgtagaggcaacaatgacacccttgtcagcagtgatggcgatcgtttccttcagcaggtttttataatccttggccgcgctgaaggtgcgtttttttgtgcgcgcaaaggaaggcggatcgagaataatcagatcaaagcgcaaatccttttttgcagcatatgaaaaatagttaaacacgtccatcactttaatgtcgtgcgcttcgtaatccagcttgttcacgctgaattgctcgatcgttttggccagacttcggtttgccacgtcgacgcttgttgttttctccgctccgccaagcgccgctgccacggagaatgcacccgtataagaaaatgtatttaaaacggttttcccttttgcatagcggtctctgatcgccttgcgcacatgtctctgatccaaaaagatgcccgtcatggcgccttcattcagatccaccgcgtattgaatgccattctcctggatgatgatcgggaactcgccccttctccctttcacgaagtcatcatcttcaacgtattgtccagccgtgtcgaagcgtttcttctcgtaaatcgctttataatcaagatccagctcatccaatgcggaaatcagcatgtctttaaaggtgtaaattcccttgctgtaccattgaatcagcaggtagccgtcataatagtcgatggtgacgccgccgacaccgtcgccctcaccgttgaacaggcggaaagctgttgtatcttgagcctcaaatagtttggcgcgcgcttgggccgcttttgttaatttggtgagaaaaaatgcctggtcaacctgttcatgtttattgcgggtaagcgtccagccgacccctttgttttgcaggccataatagccccgcgcgagaaactcgccgctctcagacacgatatcaacgaggtctccttctttcatgtgccccgcactccctgcgagagcttctttttcaataaggggatagcctttttttattttggcagcgtgtgctttttttagggtgagtagcttcatatatgtcgtcctctttctgtttgctttctcttatcgtaccacaaaacgccaagatgtctgcattgacagaaaggaaaggtttttctacgatagacaaaaagagtttcgaggaggagcagcatgccaaaacgaattgaccatacaggcatcatggtaagagatattaacgcgtccatcacattttatgaagaggtactcggcatgaaattgaaggatcgcatcacacacacgaacggtgtaatcgagcttgcttttctcggctttgaagacggcccggaaacagaaattgaactgattcaaggctacagcagcgagcttcccgctgaaggaaaagtgcaccacattgccctgctgactgatgacatcgcggctgaatatacaaaagcggaaaaaatgaacgcaaaatttatcgacgaggagatcacaacacttccaaacggataccgttatttctatatcgaaggccctgacggtgagtggattgagttctttcagcggtaaaaaaaaagaacgtacattttgtgatgtacgttctttttttatctataccaactgatatacgttgactcatcgcaaatcatagcttcccagcccatacgctcaaccaattcatggatgtttttatctttggctaaaaagacattaatgaatgagtcatatacactcataaacacaaaatccattttctcatcagttaaaacgagctctgctgcggcttcatcaagaaccgtccgcaagttggcctcagttatgtccaaaacgccgcggttttccacaatcggttctgcgtaataaaaccgattggatccgttcgcacctaatacctttaccaaactcggaatatgaaaatttgaaatatgatcctcactgggataatagaggtctccatttatgttttcatgtaacacctcagccaaatcctctctcgcgaactcgtcccttaaagcgcctatcgacgtcattaaagccagcgccagctcagcatgtgtttgaaagccgcaagaagacataaccttcttccaggaaacagccttgcctattcctcttatttcatcatcgtttggataaatatgctcgtaatcattttttctttttgcattctcccatccttcaggcatttggataaaaggagaaaagataagtgcagcagatgagtattcaactggtacttgttgtaagattggtgattcgtcatctaaccatatataatctagcatgcgcacctcctttacatattctaacattctctttcgtttaaaaggagatgatcagccctatgacaggctgatcatctatcacatcacatttttatccccagattcaaccgcactctcttcccgccatttttgatgatcccatattctgaaaaacggatagtagatggcacaggtgatcagcagattcaccagctgcataacggcgcccgacacctttccgcctgtcgccaggtaacctgatatgagcggcggcatcgtccatggcaccgcgattccggccggtcttgccaccagcccggtgctcatgccgatataagtcgcggtaatcgtgaggagcggtgcgatgataaatgggacaataaggagcggattcatgacaatcggcatgccgaaaatgatcggctcgttgatattaaatagcgcagggccgattcctaatcgtccaagctgcttcatttgtttgctccgggagcgcacaagcatcgtcaggacaagcgccaacgtcgccccgcttccgccgacattgatccaaatttgaaaaaactgagtcgtaaaaatactcggcaacgcctcgcccgcttggaaggcaagacggttggcatccatcgcgccgtaccaaatcggcgccatgattccgccaatgatggaagccccgtgaatcccgcacgaccaaagcagcatctgcacaaattcagcgatcaggcttccgccgagactgccgccaaggatggaaagcggtgtcccaagcaggtctcctacgacattgtgcagactctgaaaaggtgtcatttcaatcaaaaggcgcgccagccacacgagaaacacaatgataaagccgggaatcagcgcgacaaacgatttgcttaccgcaggcggcacaccgtctggcattttgaagacgatatttttttgaataatgtaccgatagatttcggttgaaaacaaggcaatcagcatggcgacaaataagcccttgctgccaagtagcgtgatcgggattccgccccctaccatgatggactccgttgagccatccggtgtaaacggcacctcaaacggcgttgccaatagaaatgcggcaattgaaatcgctccggccgaaagggcatcaacaccatagctttccgccagccgataggcgatcccgaaagcggcgatcatcgccataatatcaaacgaagcattgacgggatatccgagcttatcagcccactccttcccaaacacactcgccatgaaatcagcataccccggaatcggcaggctcgttaaaatcaagaagacagacccgataataatcagcggcatggtcaggataattccgtcacgcaaagcgctgaggtgccgctgtccggcaattttcccggcgacaggcattattttttcttccattacccgagtgaatgcgctcatcttaaaagcccccttttcacattgctttgtgaacaacctccgcaatgttttctttatcttattttgaaaacgtttacaaattcatttggaaaatttcctcttcctgcggaaaaaatctgcattttgccaaacaatcctgtctatgaaaaattttttccttctaactattaatctctcttttttctccgatatatatatcaaacatcatagaaaaaggagatgaatcatgaaaaacatgtcttgcaaacttgttgtatcagtcactctgtttttcagttttctcgccataggccctctcgctcatgcgcaaaacagcagcgagaaagaggttattgtggtttataaaaacaaggccggaaaggaaaccatcctggatagtgatgctgatgttgaacagcagtataagcatcttcccgcggtagcggtcacagcagaccaggagacagtaaaagaattaaagcaggatcctgatattttgtatgtagaaaacaacgtatcatttaccgcagcagacagcacggatttcaaagtgctgtcagacggcactgacacctctgacaactttgagcaatggaaccttgagcccattcaggtgaaacaggcttggaaggcaggactgacaggaaaaaatatcaaaattgccgtcattgacagcgggatctccccccacgatgacctgtcgattgccggcgggtattcagctgtcagttatacctcttcttacaaagatgataacggccacggaacacatgtcgcagggattatcggagccaagcataacggctacggaattgacggcatcgcaccggaagcacaaatatacgcggttaaagcgcttgatcagaacggctcggggatcttcaaagtcttctccaaggaattgactggtcgatcgcaaacgggatggacatcgtcaatatgagccttggcacgacgtcagacagcaaaatccttcatgaggccgtgaacaaagcatatgaacaaggtgttctgcttgttgccgcaagcggtaacgacggaaacggcaagccagtgaattatccggcggcatacagcagtgtcgttgctgtttcagcaacaaacgaaaagaatcagcttgcctccttctcaacaactggagatgaagttgaattttcagcgccggggacaaacatcacaagcacttacttaaaccagtattatgcaacaggaagcggaacatcccaagcgacaccgcacgccgctgccatgtttgctttgttaaaacagcgtgatcctgccgagacaaacgtccagcttcgcgaggaaatgcggagaaatatcgttgatcttggtaccgcaggccgcgatcagcaatttggctacggcttaatccaatataaagcacaggtaacagattcagcgtacgcggcagcagagcaagcggtgaaaaaagcggaacaaacaaaagcacaaaccgaaatcaacaaagcgcgagaactcatcagccagctgccgggctccgacgccaaaactgccctgcaaaaaagactggataaagtacagtcatacagaaatgtaaaagatgcgaaagacaaagtcgcaaaggcagaaaaatataaaacacagcaaaccgttgatacagcacaaactgccatcaacaagctgccaaacggaacagacaaaaagaaccttcaaaaacgcttagaccaagtaaaacgctacatcgcgtcaaagcaagcgaaagacaaagttgcgaaagcggaaaaaagcaaaaagaaaacagatgtggacagcgcacaatcagcaattggcaagctgcctgcaagttcagaaaaaacgtccctgcaaaaacgccttaacaaagtgaagagcaccaatttgaagacggcacagcaatccgtatctgcggctgaaaagaaatcaactgatgcaaatgcggcaaaagcacaatcagccgtcaatcagcttcaagcaggcaaggacaaaacggcattgcaaaaacgattagacaaggtgaagaaaaaggtggcggcggctgaagcaaaaaaagtcgaaactgccaaggcaaaagtgaagaaagcggaaaaagacaaaacaaagaaatcaaagacatccgctcagtctgcagtgaatcaattaaaagcatcccatgaaaaaacaaagctgcaaaaacggctgaacgccgtcaaaccgaaaaagtaaccaaaaacctttaagacttgcattccaggtcttaaaggttttttacattctaagaacatcgtacacaacctttttcccatccgcctcacaggcttttcatactattgctatacagccatgaacagcataaaatgaacgttattacagttatcaccacatatggcgggattgtgactgggcaggcaggcaagacccaatgatgcaaagggagtattaatgcctaaaaagcagggcattttaactcttcttttcgtgttgggctcataacggcgccttggacaaccccctattctcatgctccgtcgtcgcgtcgacgcgggcatttttgtcattttcagccgatatttctcacttttttcattttgattgtcaacttttcatttgatacgatgaacaagccgacttttcttcagcaaaggaggttttgattgcttgcataaagagattgcaaaagaattactgctgctcgcaggaggaaaaaacaatattatcagcatcagccattgtacgacccgtcttcgttttgatgtaaaggacgagacgaaaattgatatacatgccattgagaacctgcaaggtgtgcagggcacctttttccgttatgggcttttccagattatcttcggagcaggcgtcgtcaacaaaatatataaagaagtcgttcatgtatgggagaacgcgccttctgaagaacctgtccaccagaaaaaagccagccggaagctgaaccctgccgcagcttttgcgaaaacactgtccgatatttttgtgccgattattccggcaataacagcaagcggcctgctcatggggctgatcggcatgattaaggtgtttcactggttcgctgccggcagcccatggattaaaatgctcgacctcgtgtccagcacagcctttattttactgccgattttagtcggcttcagtgccgcacggcaatttggcagcaacccatacctaggggcagtgatcgcggggcttttgacgcatcctgatctgctggacccgtctatgctcggcagcaaaaccccgtcttctttagacatatgggggcttcatatcccaatgatgggctatcagggttccatgataccgattcttctttccgtttttgtcatgagcaaaattgagaagctattaaaatcgattgtgccgaagtcgcttgatgtcgtgatcattccctttattacggtcatggtgacaggatgcctcgcgctgattgtgatgaatcccgccgcgtccatcatcggccagatcatgacacaatcgatcgtctatatttatgatcacgccggcattgccgccggagctcttttcggcggcatctactccaccatcgtcctatctggattgcatcatagcttttatgcaattgaggcaacgctgcttgctaatccgcatgtcggtgtcaactttttagtgccgatatggtcgatggcgaatgtggcccaaggcggagcggggcttgcggtattcctcaaaacgaaacaatcaagcctgaaaaaaattgcgctccccgcttctctgaccgcgtttttaggcattgttgagccgattgtattcggggtaaatctcaaattgatccgtccctttatcggagcagccatcggcggtgctattggcggagcatacgtggttgcggtacaagttgtggcaaattcctacgggctgacaggcattccgatgatttcaatcgtgctgccgtttggcgccgctaattttgttcattatatgatcggtttcttgatcgcagccgtctctgcttttatagctacattgtttctcgggtttaaagaagagacagaataactggatttattcgttttcattcataaaacgggggatgaaaggacaaaaaagctatgaaaattaaaagaatcttaaatcataatgctatcgtcgtaaaggatcaaaatgaagagaagattctcttgggtgcaggaattgcgtttaacaaaaagaagaatgatattgtcgatccgtcaaaaatagaaaaaacctttatcagaaaagatacacctgactataagcagttcgaagagattttagaaacattgcctgaagaccacattcagatttctgagcaaattatctctcatgccgaaaaagagctgaacatcaaaatcaacgagcgcattcatgtcgctttttcagaccatctttcttttgcgattgaacgcctgagcaatgggatggttatcaaaaatccgctgctgaatgaaatcaaagtcctttatccaaaggagttccagatcggcttatgggccagaacactgattaaagataaactggggattcacattcctgatgatgaaatcggcaatatcgccatgcatatccacacagcaagaaacaatgccggcgatatgacacaaacgcttgatattacaacaatgatccgtgatattatcgagattatcgaaattcaactgtctattaatatcgttgaagataccatctcttatgaacggctcgtgacccatctccgctttgccattcagcatatcaaagcaggcgaatccatttacgagttggacgcagaaatgatcgacatcattaaagagaagtttaaggatgccttcctgtgtgccctaagcatcggcacctttgtgaagaaggaatacggctttgagtttcctgaaaaagaattgtgctacatcgccatgcatattcagcggttctaccaacggtcagtcgcacgctgagacaaacaaaaaacgcttttgatcatctcaaaagcgtttttttatatctgtattattggttgatcgccgggttgctgatcgtattccacttcgtataggacatgtaatggaaatactcatcgcgatacggatgttttgtattggagttccaaggcttttctccgccgcagaagtgcacgattgccgggttttctctcgtttcattatattgcttccgccctaacagagtcgatggggttttcagctttaacatgatataggtttgagcgttccagcgcggatgaagttcataccactgatcatataaaatcgcattcagtgcatcttggtcatgcagcacaagaaagtcttcgtctgggtgttcattgataaagttgatgactttttctgtgatgttttgctttctccaagactcaaaatcaataatcatgatacctgagttaaaatacttccctgtatcagtgacgttcatttctttcaggcgttcatgctgccccgcatcctcaacagcggctacggtgtatggcgcaatgtctaagtcccatagcttagaaatatcctctaggacaagcgcatcacaatcgatgtaaatcattcgtttgatgctttcatccttaattaagtcgggaatcgaaatgcggtaatacgcggcttttgtaatatggctgctctctaccgcatgttcatacattttggtatccacttctaaaaactcaatcggcactccgaatttcaaagtggtttcttccagtctttttttgttatcaggcttaattccgccatcaatgacgtataattttacctctctctcctgatccatgttagtcaataaagaaacgaacatcccacctaaatgacgagcataattatcatctgcgcatgatacgatatgcatgatttcatctttcctcaatggtattcatctccctttttgttgtacaagttacataccctttttcaaaaaaataaacacgttctccgacatttttttaaacagaatgtgtgatacaacaaaaaaggtgtcattttttgaagatgcgataaagccagtaaagaatgaaaaagcttgcgattgtgatggcttcagccgagacgatataccacggccatggcccgagaacatctaagagagaggatccgcccggttttttcgtcaaatacatataattcgcgccaagccagcgatcaatcaggaaaatacagacgccgtacacattaacaagcaggactgtcacccataacgagcgctggcccattctgtaggtgccaatcacagccatcagcagacaggataaaaacacagacccgtgagaaataaaaaagaggatatatcggatatgcggaaatgaaaacattccgaggtcaggagtggcaagagcctgaatcgaactgccgatgccgacaaaaaacaaaaacacaaacagctttctgctttttgtcactaacataatagctgacaaatacaccgacaggtcactaagctggagaggcaatgaagtgcgcaccgaccacctgcccgtggcgaccaaccatatttgatagccgatttgcgaaccaagcaaaagaaacacaaacagagaacgcaaaaaccggctggccctcggctgcttgaccccctcttggaacaaaaccaacagaatggccaaaagggcgataatcgctaacgtcactacatgctctgtcgaaaacagatgaaacggatcatgcttatagacggattgaacatatttttgcaaaactgcacccccgtttgcggttttttgtttattttggcgttgtttgggctttttttattcaaccgatatatgggcttgaagttcacatcatcctctgttacaattcgtttcatagctaatgattctgataatttaaggcaggtctaaaaaatggaacgttcacatcaacatcagcagcttcggaaggaagaacacgatacactttctaagctcaaacaaatgcccgtcgagtcactcaacctggaagccatttcgatcgctacgaatctgtatcggtctgcacaaaggctccgtgtcaaaatggagactgaggttctttcttcctataacctttcttggaccgctttctccattctttatgatctatgggtatggggagcgctcgaaacgagaaaaatcgctgagctgtcagggatatctacagctacagcaagcaacgtgatcaaaacgctcgaaaaaaagagtttttgccgtaaaagcatcgacacaagagatcggcgactcgtgtttgtctcaatcaccgattccggcaaacaagcgatcgaagaactctacccggagtttcacaaaggggaaacagagctcattgcgggaatgacgaaggacgaacagaaaatattgacagggctgcttagaaaggtagctgacaatcttcatacaacataagctttgacgggaatccagtagcggtttgtctccctgtttcagagagccggcggaaggtgcgagccggcacacagcaaacgtgaattacctccccgagctttctttgtgaccttaaaagtagcaaagaacgggaaaccgttattcgaatgagcggaagacgatgtcttcaaccagggtggtaccgcgtgcattgagccacgtcccttatcgggatgggctcttttttgtgtttgtaaaaaaggaggaaaaatgatgaaaacatttgagcagctcacagcgtcacagcaaaaagaggtagaaagacagcttcagctatacatgacaggcgcccacgaagtcataccgccggaggaattaaaggcaaagctcgtgaaatcaatttccacgggcacgccgcttaaaattaagctcggattagatccgtctgcaccggatgtacatttgggccatacggttgtgttaaataagcttcgccaatttcaagaaaacggccacattgtccagctgttaattggggatttcacaggaaaaattggtgatccgaccggaaaatcggcagccagaaagcaactgactgatgaagaagttcagcacaatgccaaaacctactttgagcaattcggaaaagtgcttgatccagaaaaagtcgagcttcactataactcaaaatggctgaaaacattgaatctggaagatgtcattgaattagcagggaaaataacggtagcccgcctgatggagcgcgacgactttgaagaacgcatcgccatgcaaaaaccaatctcactgcatgaattcttttacccattgatgcagggatatgattctgtcgttctcgaaagtgatattgaattaggcggaacggatcagcatttcaatgttctcatgggacggcatttccaagaacgatacaacaaagaaaaacaagtcgtcatccttatgccgctcttggaaggcttggatggcgtcgagaaaatgtcgaagtcgaaacacaactacattggcattaacgaacatccaaacgacatgtacggaaaaacgatgtcactgcccgacagcctgatgaaaaaatacatccacttggcgacagacttagagcttgaagaaaaaaaacagctcgtaaaagacttagaaaccggcgcagttcatccgcgtgatgccaaaatgcttttagccaaaacaatcgtccgaatgtatcacggagagaaagcagcagaagctgccgaacactcgtttaaaacagtctttcaggaaaacagcctgccggaagatataccggccataaactggaaaggtgaaaaaacgatagcgatgattgatctgctcgtcaagctaaagctcctctcttcgaagagcgaggcgcgccgcatgattcaaaacggcggtgtacgcatcgacggagagaaagtaacagatgttcacgccaaagcagagataagagagaatatgatcatccaagtcggcaaacgcaagtttttaaagctccaatagtctgatattccgaaacgcttatgacccttcattcataagcgtttttttgcaggtataaagcagtcttttcaaaaacgctctccatcttgcaggaaactcctttagcatcccgaaatattccccaaccatacatttaggggaggtttatttttgatgaaaaagcttttgactgtcatgacgatggctgttttaactgccggcacactgctcttgccggcacagagtgtcacccctgccgcgcacgctgtacaaatatcaaatagcgagcgcgagcttccattcaaagcaaagcatgcgtactctaccatttctcagctaagtgaagcaatcggccccagaatagccggaactgcagctgaaaaaaagagtgccctattgatcgcctcatcaatgagaaaattaaagcttgatgtgaaggttcaacgattcaacattcctgaccggcttgagggaacactgtcttcagcaggacgcgatattcttctccaagcggcatccggctcagctccgactgaagagaaaggactgacggccccgctttacaatgcgggattgggctatcaaaaggactttaccgctgacgtcaagggcaaaatcgccttgatttccagaggagacctgacttattacgagaaagccaaaaatgccgaagccgccggagcgaaagctgtcatcatttataacaacaaagaaagcctcgtgcctatgacgccaaacctgtcgggaaataaagtcggtattccggtcgtcggcattatgaaagaagacggcgaagcacttacccagcaaaaagaagccaccttaaaactaaaagcattcacaaaccaaacctcccagaatatcatcggaatcaaaaaaccaaagaacatcaaacatccagacattgtgtacgtgacggcccattacgacagtgttcctttttcgcccggagcaaatgacaacggctcaggtacctctgttatgctggagatggcgcgtgtcttaaaaagcgttccatctgataaagaaatccgctttatcgctttcggcgccgaagagctcggcctgctcggctcctctcactatgtagatcatctatcggaaaaagagctgaaacgaagtgaagtgaacttcaacttagacatggtaggcacaagctgggaaaaagcgtctgagctgtatgtcaacacattggatggccaatctaactatgtttgggaatccagtcatacggctgctgaaaaaattggatttgacagcctgtctctgacacagggaggatcatctgatcatgtgccattccacgaagccggcattgattccgccaactttatttggggagacccggaaacagaagaagttgagccgtggtatcatacccctgaagactcgatcgaacatatcagcaaagaacgcctccagcaagcaggcgatcttgtgacagccgctgtctatgaggctgtgaaaaaagagaagaaaccgaaaaccattaagaaacaaatgaaggcgaaagcatctgacatttttgaagatatcaaataaaaaaagacggcacttgggtgccgtcttttttttataatgatcagctgtttagccgtctataagtaaagctttcagtttatcaactgtattttctttttctaacgggcgataaatggtcagtttcaaatcaggagagtcatatatttgtaatgtcatatgctccatcaccattgttccggctgccgggtgatgaagtactttttctcctgcgtgtgtgcctaatacttcgtggtggttccaccattttttaaattccgggcttctttcagttaactcatcgatcagctcttttatccatgcttccccaagaaaccggctggctgtcgatcgaaactgtgcgataagttttttggcgtggctttcccagtcgtcaagcagatcccgatactccttcgaggtgaaacatcgccatatggcattcctttccttactgcccatttggccaaaattgccgaacacagcacaagctgctgtgttccaagcaataacgtcccacttttcgtcagtcacataaacagggcaattggttaaatgatcaataaagtgccgcacagccagaggaaggctcttattatcttcatcctgatcatctaaaggaacatgatggccagccaacagaaagacatgacgcttttcctcataattcaatttgagcactctcgatatgctttccagtacctgtgttgatacccgaatatcccttccctgctccagccatgtgtaccatgtgacacctataccggacagctgggctaattcctctcttctcaagcctgttgttttccttctggtacccataggcaatccaaactcttgcggagaaagctgtgcccttttcagttttaaaaactcccctagctctttccgtttttctgccatactgtccacatacacactctccttttgcatagaatttcctattagtattctacataaaaaggagaaggtttttatattatttgtttcgttctccaaatacttcagcggccacaggaagaatggtattcagtgcattcggaaaacctgagtaaataatcatctgcatcatgacttctatgagttcttcttgtgtccatccgacattcagggctccgttaatatagaattttagctgctgggtattgcccaatgcagtcaatccagcaacggttgctaataatctggatttcagatcaagacctggtcttgaaaaaatctgaccgtagttaaactccacggcaagcacaccaaggtccggagcgatggaatgtttaaaattgtccacgatcgcttcatagttctcctcatcaatttgtttcagaatatctaacccttttttataacgttcacttgttcgcatcagcttctatctcccttccaatatcgcttttttagtagtacggtttatggtaatccttgaactgaaggcaataccgaccatgatcatccccaggatacaaacaccgttccaatgaaacagcatccagaccgcaccccctgcatacgatcccaaggcgccgcctaaaaacgtgctgaccataaagaggccattcaatctgctcctcatttcagccgacaattggaaaatctccgcctgacacgccacctgattcgcctgaatgcccatggtgatgaataaagcgcccaatacaatcacaatcaatgaagtctggcctgccattaataaaacaaatgacaataaggtaaaagacatacaaagcttgttggaaaaagcagctcctttttgatcaataatccggccgatcagcggagttgcaaaagccccgccaattcccaccaaaccgattgttccggcagtctggctgccaaacgagaatggaggttcactcaccataaacactaacgtcgtccaaaataaactgaaggcgccgaacatgaagccttggtttacacatgcttttcttaacactttctccttgatcaaaagcggaaataatgaagaaatgagttttccgtaatgaaatgcatgtgtccctttgcttttcggaaagcagaagtgaatgatcaacataatgatgacggctgctgcacaggcaatccaatacatcacgcgccagccataatgggcatctatcgccccgctgaccactctcgcccctaaaattccgcaaaccaagccgatagctacgtttccgagtacttttcctctgttcctgtcatttgctaaacctgccgcaaacggcacaaggatttgaggaataatcgtgaagaatcccaataataaatttgtgatgactagccatggaaagcttacagctaacgctgaagctgccgaacaaacccccactaagaatagcaggctcacaattaagcggcggcgttcaaaaagatctcccaatggaacaagcagaaggttccccgccgcatagccaatctgcgccaatgtagcaatcattccagcttgtgccggcgtcatatgaaacgtgcctgccatgctgacaagcaatgtttgattgatatagacattggctaccgtaaacccgctagtcaccgcgataagaaaaatcaaacctctcgataatgaaatggaatggttcatgtttacctcctttcttcatgcatgataaagcaggttcaatcatggaaacagaagtgagtttatactggtataaaaagtactagcaagcaaagcaaaaaagcgaaaccctgtcaggcttcgcttttgttatcaatccacttctttcttaatccccagcattttctcatctaggtaatgggcaatctccgcggcttccttcagctcatctgttaattgcttaggaacgtcattgttcaatttatagtaaattttatgttcaaggctcgcccagaaatccatcgcgattgtccggatttgaatttctgctttgacgtattccacacggttcgttaaattcacaggcatctcaatgattaaatgcaggcttcgatagccattcggtttgggtgtctggatataatcctttacctttacgattctcaaatcttcatgctgcttcaacacattcacgacattataaatgtcagaaataaaggaacagatgatgcgcacgccggcaatgtcgtgaatatgctccttcatttccttcgtcgtaatctcacagccctttctcattaacttattcacgatgctttcaaagcttttgacacgggattttgtatgttcaatcgggttgtgtccgtgaatgaggttatattcctggctgataattgagaactttgtatcgagcgcatctagcgcaaatttataaactaataattcatttttccaatcttccattactgtttttaaatcgtccatatgtgttacagataaatccattttcgtcatctcctttaacggaactttatccgctgtccatgtactagacgtccctgtctgctgcaaggttctatgaatttttttacaaaatgcggtcgattgtaacaaaaaaagaccgcacgaaacgagcggtcttttttattatcggaaatagctgatcaataatccgatcgagagcaggaatccgaaaaatgtatttgtttgggctgttgatttcattgcgacaatcatattcatcggcatttcgttctggacgaaacccttcactgcctgaaccggcttaggcacgctcaaaaagacgacaaacagccatgggcttgcggcaccggtaataaccaagccgacaacccagatataagcgacggcaaacgacgcagctaacagagtaacagctcccttatgccccatcaaaatcgccaatgttttgcgtccgccttttttgtcctcttcaatatcacgaatgttgttcgacaggttaatcgcgccgacaagaatcgcaatcgggatggaaatcaaaatgctttgcgtgttgatcatatctgtctgaatgaaaaacgaaatcagcacaaacaccgaacccatgcaaatgcctgagaataattcaccgaacggcgtgtacgcaatcggcagcggcccgcctgtatacaggtagccgatcgccatgccgacaaggccgatcagtgcaagccaccagctgctgcttgcacaaatatagacaccgagcaaaatggcaatcccgtatgaggcaagagctaattgcaaaatcgttttaggcttcattccgtggcgtacaattgcccctccgattccgactgattctgctgtatctaatccgcgtttaaaatcatagtattcattaaataagttcgtcgcgatctggatccataggcaagaaaacagcatagccaaaaacagcagcagatcaaccttcacataaaacatcgccaaaacggttccgagcagcacaggcacaaacgatgcggttaacgtatgaggacgggttaactgccaaaggatctgccccatgctttctttttgcggcgctgtctgaccctcacccttatttgtttggttcatcttcctcttcctttctattaaaaggcttactttttttcagccggcagcttaataaaaaactccttttgcttccttatctatcataatgacttctcccttatttcacaagataccgcaagaaggcgttttctttcttattatacgcttctcgccctgatttcattaggtttctgctttcacttgaacgaacaggtacagaaaaatttttttaagtacattacactttttaaaagttaaaaagatcttttgactccagctatcttttcctttattatgaatcagctcgaaacattccattcttgcccttgcaggtataaagattcattttcaaaaacatacgccgatatattaatttgagggagattagggaaaaaatgaaactttttgagcatctgatcgtcaaataatcatgtgattgtcgaaaaaacgggaagggaatttttgatatgctgcaattaatgaaacagctgtatgaaaaacccgctgtcaagtggacatgtcatacaggcttttatttgatgatactgcttgttttgttttttatgtatggttttcacaccgcgaataccggttcatatatttataacgatttctaattggagagagaataactatgaaacttttacatgctattcaaacacatgcggaaacttatccgcaaaccgatgccttccgctctcaaggccagtcgctcacgtatcaggaattatgggagcagtctgaccgcgcggctgccgcgatccaaaaacgcatttctggggaaaagaaatctcctatccttgtgtacggccacatggagccgcacatgcttgtttccttcttgggaagtgtcaaagcgggacatccttatattccggttgacctgtccattccgtccgaacggattgcgaaaattatcgaaagctctggagcagaattgctgatccatgcagcaggactctcaattgatgcagtcggccagcagattcagacagtttctgcggaagaactgctggaaaacgaaggcggctctgtcagccaagatcaatgggtcaaagaacacgaaacgttttatatcatttacacttccggaagcacaggaaatccgaaaggcgtgcagatttccgctgcgaaccttcaaagcttcacagactggatttgtgcagactttccagtcagcggaggaaaaatatttttaaaccaagcaccgttctcatttgatttgtctgtcatggacctatatccgtgccttcaatcaggcgggactttacattgcgtgacaaaggatgctgtgaacaagccgaaagtcttatttgaagagctgaagaagtccgggctgaatgtgtggacatcaacaccttcctttgtgcaaatgtgcctgatggatccaggtttttcacaggatctgctgcctcatgcggacacatttatgttttgcggagaggttcttccggtttctgtggcaaaagcgctgcttgagcgttttccgaaagcgaagatttttaatacgtacggcccgactgaagcgacagtggctgtcacatcggttgaaattacggctgacgtcatcagccgcagcgaatcgcttccagtgggcttcgccaaaccagatatgaacattttcattatggatgaacagggacagccgcttcctgatggagaaaaaggagaaatcgtcattgcagggccgagtgtaagccgaggctaccttggtgagccagagctgacggaaaaagcgtttttctctcatgaaggccagtgggcataccgaactggcgatgccggctttattcaagacggtcagattttctgccaaggacgtttggattttcagattaaacttcacggctatcggatggagctggaggaaatcgagttccatgtcagacagtcacagtacgttcgctctgctgtcgtgattccttatcagccaaacggaacagttgagtacctgatcgctgctattgtgcctgaggagcatgagttcgagaaggaattccagctgacaagcgctattaaaaaagagcttgccgcttctcttccggcatatatgatcccgagaaaatttatctatcaggatcacattcaaatgacggctaacggcaaaattgaccgaaaacgcattggcgaagaggttcttgtatgacgccttacagctcgtttttattctttatactgcttggcattcttcttctgccgacgatcattctcggcttaaacggaaaaagatttcaagcatacaacatgttcatatctatcattatattggctttaattttttcgcatgacttacacggggtcatcgcgctgtgcctgtttacaatatggcaggtgctcctgatcagcggctatctggcataccggcagaaagcgaacagcggctttgtcttttgcggggctgttatcgcgtctattctgcctttatttctgtcaaaaatatggccgtttctttcacacccgcagccgcatcatccgccgcataacctgatcagctttttagggatttcatatttaacctttaaaggcgttcagctgattatggaagcaagagacggactgctgaaagaacagctgccattgcaccgcctgctgtatttcatcctgtttttcccgacgatttcctccggcccgatcgacagataccgccggttcgtcaaggatgaacagaaggcttggacgaaagaagaatacgccgacctgttgtatacgggaatccataaaatcttcatcggtttcctgtataaatttattatcggctacgcgatcaatacgtacttcatcatgaatcttcccgcaatcacgcacaataagattcttgggaacctgctgtacatgtacggctacagcatgtatttattctttgatttcgccggctacacgatgtttgccgtcggggtcagctacattatgggcattaaatcaccagaaaactttaataaaccatttatcagtaaaaatattaaagatttctggaatcgctggcatatgtctctgtcattttggttcagagattatgtgtttatgagattcgtattttggatgactaagaaaaagtggatcaaaaaccgtatggccgtctcaaacatcgggtatttcctgctgtttatgctgatgggggtttggcacgggctcgcgccgcaatatatcatttacggcctctatcacgccgtgctgatgacgtgttacaactttttcgagaagtggaataagaaatataaatggctgccgtccaaccgctggacaaccattctcgctattgtgatcacattccatttcgtttgcttcgggttttacattttctcaggaaaaccatttcatcaccaccattaaaggagattagaaagctatggattttaaacaagaggtattagacgttttagcagaggtttgccaggatgacatcgtaaaggaaaatcctgatattgaaatttttgaagaaggtttgcttgattcttttggaacagtagaattgctgcttgcgattgaaaaccgttttggtattttagtgccgatcactgaatttgaccgggacgtttggaatacacctaacaacattgtaaatcagctgtctgagttgaaataatgaaaaagcgttttttcggtccaattattttggcgtttattctattcgcaggcgccatcgcaattccatcttcatggctgacaggcttcatcaccgataagcgtgtgaaagagtcagcaacagccttgaatccgagtatgtttcaagggctatatttacaagatcagatgctcaaagatccgacatatcttccgatttacgggtcttctgagctttctcggctggacgagttccacccatctaattattttcaggtaaacaatgagggattcacgccataccttgtcggcaaaggcggatcccagtcattgattcattctttaaacttcgctgcccatatggatcagctgaagggcaaaaaaatcgtattcatcgtgtctccgcaatggtttattaagcgcgggtctgatgaacagcatttcgcgccgaactattctgcgctgcaagggcttgatttggcatttaacgatcagatcgatcctgaaattaaaaagaaaatgatgaaacgcatgctgcgctttaaggctgtgcaaaacgatgccattctttctgagctgtacaaagcaatggtaaacggccagacgtggaaagtgaacgcgctgaagccggcggcgaaagtgtattacagcatgctggaaaagaaagatctgtattattcaacgacagaatcatccgggccaaagcgctatatctcgcagtcagtaaaggataagtcatggtctgaattgaataaactggcggatcaatcgggcaaacgccactccggttctaacgattttcacatcgacaaccctgtctataaaaagctgaagccgaaagtgcctaagctgaaagggaaaaacaaaggaagatcgtatgcggtgtcaccggaatatggcgactttgaaatgatgctcgatatcctgaaggatgcgggcgcagagcctatgtttgtcaccattcctgttaacgggaaatggtacgattacacgggcttcccgaaaaaaggacgcactgactattacaaaaaggtaaataaacaaatcagagcgaagggcttccaggttgctgatttctcagggcatgaatatgacccgtatttcatgaaagacaccattcacatcggctggaaaggctgggtgtatgtcgataaagcaattgacgaattttataaaaccggaaaagtcacttcatcctgagcatctcataggacgcggctgcatatttcctgctaagatttgaaatagtaaagaaatcacagccaacttaattaagaggtgttacatccaatgaagatgacaggcaatacggttttaatcacagggggttctgctggcatcgggcttgaactggccaagcgcctgctggaacttggcaatgaagttatcatttgcggacgcagcgaagcacgtcttgcagaagcgaagcagcagctcccaaacatccatacaaagcaatgtgatgttgcagaccgttcgcagcgggaagcattgtatgaatgggctttaaaggaatatccgaacttgaatgttctcgtcaacaacgccggcattcaaaaggaaattgactttaaaaaagggacagaggatctttttgtggacggtgatgaaattgaacttaatttccaagcgcctgtccatttatccgcccttttcacacctcatttgatgaagcagcctgaagcggcaatcgttcaggtcacatccgggcttgcgtttaacccgttagctgtttatccggtgtactgcgcaacaaaagcggcacttcactcgttctcgcttacgctcagacaccagctccgcgacacgagcgtggaagtgattgaaatggcaccgcctatggtggacacgggcttaaaccaaaaatcacgcgataaacaaggcctgacgtaccggggcatttcatctgaagaatatgttcaatatttcttggacggcttgaaggaaggcaaacaggagattacaaatgaacgggttgaaggtcttcgggatgccactcgcgccgattatgacaggttattcaagcaaatgaacacgcaggagaattaatttctcctgcttttttcatatgaatttcttacaaatttgagcaaacctattgcgattatttgttgaaggtatacaatagaatataattattttcaaataagtttgataatataaacaatttaacagcagggagattgaccatgactaaacaaacaattcgcgttgaattgacatcaacaaaaaaaccgaaaccagacccaaatcagctttcgttcggaagagtgtttacagaccacatgtttgtaatggactatgccgcagataaaggttggtacgatccaagaatcattccttatcagcccttatcaatggatccggccgcaatggtctatcactacggccaaaccgtgtttgaagggttaaaggcttacgtgtcagaggatgaccatgttctgcttttcagaccggaaaaaaatatggaacgcttgaatcaatcaaacgaccgcctctgcatcccgcaaattgatgaagaacaggttcttgaaggcttaaagcagcttgtcgcaattgataaagactggattccaaatgcggagggcacgtccctatacatccgtccgttcatcatcgcaaccgagcctttccttggtgttgcggcatctcatacgtataagctcttgatcattctttctccggtcggctcttattacaaagaaggcattaagccggtcaaaatcgctgttgaaagtgaatttgtccgtgcggtaaaaggcggaacaggaaatgccaaaaccgcaggaaactatgcttcaagcttaaaagcgcagcaggtcgccgaagagaaaggattttcccaagtgctttggctggacggcattgagaagaaatacatcgaagaagttggaagcatgaacatcttcttcaaaatcaacggtgaaatcgtaacgccgatgctgaacggaagcatcctggaaggcattacgcgcaattcagtcatcgccttgcttaagcattggggctttcaagtttcagaacggaaaattgcgatcgatgaggtcatccaagcccataaagatggcatcctggaagaagccttcggaacaggtacagcagctgttatttccccagttggcgagctgatctggcaggatgaaacactttcgatcaacaacggtgaaacaggggaaatcgcaaaaaaactatatgacacgattacaggcattcaaaaaggcgctgtcgcagacgaattcggatggacgaccgaagtcgcagcgctgactgaaagcaagtaagaaaaagccggcccagtacaggccggctttttttacgcttcaattttgttgaaaaactgcggcagatacgctttgtgcgcctccagcatttcatctaaaatctgtttggccacagtatcggacgggacaagagggttaatcgtcatggcaaggagcgcagtttgatagtcacctgtaactgccgcttctgccgcgacacgttcaaaggatttgatttgctggacaaggccgcggacagacaccggcaagtcgccgacagcaattggcttagggccagttttcgtcatcacacagttcacttcaactgcggaatcgtctggaatactcgctattgcaccgttattgatcgtgttcaccggctgaatgtcgtgtttatcattgtaaatcgagctgattaagttacatgctgcatcactgtagtaagctccgccccgtttttccagctgcggcggtttgatcgcaaggtttggatctttataaagctcgaacagctctttttcgaccttctgtacgacttcagcgcgggtgccctccatttgtgatgcttccagttcgtgctccagcatctcttttgttttgaaatagtaacggtgatagccgcaagggatgacattgagcgcttttaagaaatccggttcccattcggcgcctgagatatttttcatcgtcatcgcgtttttcgggtcgcccatcgcctcgatgacttgctccttcacacttacgccatccaagaaaacatccagcccaaataccatatggttcagtccggcgaattggacttctacgcggtccacatctacatcaagcgctttggctacgcccattttgatgccgattggaacattacagagaccgacgactttcttcaggttggagtagcgaagcaaggcttctgttaccatgccggcagggtttgtgaagttaacaagccaagcgttcgggcaaagctcttctatgtcctttgcgatctcaaggatgaccggaattgtgcgcaatcctttaaacaggcctcccgggccgtttgtttcctggccaatcactccgtattttagcggaatgcgctcatcctttgctcttgcctgcaaaagtccgacacggaattgggtcgtgacaaagtctgcgtctttcagcgcttttctccggtcgagcgtaagatgaatgtcgatcgggacgccagctttttcaaccatccgtttggcgagtgtgccgacaatattcagcttttcttcgccctcggggatatcgacgagccataattcgcgcacaggcagctcatcataccgtttaataaacccttccactagctcgggcgtatagcttgaacctccgccaatcgttacaatcttcaatccttttgtcatatgcttgctcccctttgctcggtgattttttcatataactcaatgatctctgcagccatatccttcactgtcattgcattcattaaatgatcctgtgcatgaaccatcagaagcgtcatttccgtcttttctccgctcgcttcattttggatcagctctgtctgataatgatgggcttttgacaattcttcagcagcgtcttgaagctttttccgcgcttcttctgcgtcaccgcttttcgcagcggcaatggcctccattgcggagctcctaccgtttcctccgtgaaggatgatttgaaaaatgatttgttccatttcctcattcacgcgattcacttcctttctctacagagccgcttctttgtcatctgatgctgcaggcgtttggaccagctccagatcgttttcttctttcagcttctgcttatcccacattctgaagaatggatagtagacaacaaaggacacggcaatattaatggcttgcatgaccgcacctgagacttttcctcctgtcgccaagtagcctgaaaagatcggcggcatggtccacggcactgcgatacccgccggttttgcgacaaggccggtgctcattccgatgtacgtaagtgtcactgtgacaagcggtgtgatgataaacggaagtaagagcattgggttcatgacgatcggcattccgaatataatcggttcgttaatattgaagatggccggtccgaccgcaagcttcccgagctgcttcatttgtttgcttcgggcgcgcaggaacatcgtgacaaccagtgccaatgtggcgccgcttccgccgatattgacccagatatcgaaaaattgctgggtgaaaatcttaggaagctcctcaccggcttggaaggcgatccggttggcatccattgcgccgtaccaaatcggtgccatgacgccgccgacaatgtttgcaccgtgaaggccgcaggcccataaaagcattttgacggcttcggcgacaaggcttcctccaaggcttcctcccagaatggaaagcggagtccccaataaaacgcttacaatattatgaaggctttcaaacggtgtcgcttcaacaatcagccgggctgcccaaatcaggaagatgacggcaaagccggggattaacgcgacaaatgacttgcttaccgccggcggaacaccgtccggcattttgaagactaaattgcgctggataatgaggcggtaaatctctgtggacaccattgcgataatcatggcgacaaacaggcctttgcttcccatgagcgaaagcggaatcccgccgccaaccatgatttctttcgtcgcgccatccggcataaacggcacttgataaggtgttgctaataaaaatgccgcaagggaaatggctccggccgacaaggcatcaacgccgtatttctcggcgagccggtaggcgatgccgaacgcggcgacaagacccataatttcaaaggtcgcgtcgactgggtaggccagtttttcagaccaggagctgccaaacgtttttgccataaactcagcgtatcccgggatcgggaggttgccaatgatgaggaaaaaggaaccgatgataatcaggggcatcgtgaggataataccatcacgcagcgcctgcaaatgacgctgtcccgcaattcttcccgctataggcatgaccttttcttctaagatctgattgactttattcacatagcccgcccctctctatgacacatgtccaagctgttcagctgatttcagcacttccgccccgttgcacgtgccataatggacggtattaatgacgtctaccggaaccccctttgactctcctaattttttgagctgcggaagcatgtaacggacttgcggaccgagaagcaatacatccgctttatcgatatgattttgtacagaatcgcctgaaactgcccaaatggtatagtcttttccctgttcctgcgcacttttttccatcttgctcaccagtaaactagtagacatgcctgctgcacaaacgagtaatatattcatgtaaaagaccccctagagtttgatcaattttgtaatgtcctgctgttgctatcatcatattatgaaatcgctttcataaacactcagggtttttccgcaggcaacggaaaaaaggtatatacaggctgtcagctcagcattttttggtcaaacacatccgaaagctcttgaaatgaacggcatttgaccagctggttcaccgccgccgggtcatccaaaatgctgccaagcagtttatacatgctttgcaagtccgctttgttctccttttcgacacaaagcagacagacaaattgaactcgctgactctcccaatcgatcggttttttgagcgtacaaacggcccaaaacgttgttttcgtctgcggaacaagcgggtgcgggatggcaacaagattgccaaaacacgttggcgacatgtcttctctttcaaaaatggaatctatgatttcttcatcggcaaagccgcattcgaccgctttctgccctaaaaattgaatcacttcttcttttgagcgcagatcctcctgaaaaaaaacgagttctttttttaggtagcgattggctttttccttttcatcactcagaatagattctatttttgtaaagtcagttccgcctaagatggtgttaaccttcagtactggtacagggagctcttttttaatcggaatggtactgatgacaaaatcaattgattcgtaggacatttgatcaagactataatactcagccgttccaagaatatcgagccgcttgccgaaatgggaacgcagtttttcgcgcagaagctgggcgcttccggcacccgatgcgcatacaatgatacagcgtttcggcggactttctgttttttttcgttcaatcgcggcgccaaagtggagagccaaatatccaatttcgttttcatgaatctcaatacccgtttgttcctttatcacgattccggcaatgatcccggcttcaaaagcgagtggataatgttccttgatcgctgccagcatcggatttcgaagattcatgccgtatcggttgcggctgatcgccggcttcatatgcagggccaagccgattttcagctctttgtcatgcaggatgccaagcttcagttcacgatcaacagctttgatcatggcaagtgtcagctgatcggtttcctcttctattgaaaatgtgtcctctccgcattgtgattgtgtcattcgttttgtgccaaggagatgcatggtgatgtaggccgtctcgtctttcggaaacgtaacggcaagctttgattccagctcttttacgatggcttctgcagcctggtactccttttgatgcaggatatgatccatatctttcgggaaaagagaaacatagttttccgttctgatccgtttacaggcgatagcgatatggataatgaggttattcagtcccatgttggacagagggatgcggtcgtttttcatttttttcaagatggcggaacggatgatctcaatttcttcttttggcaaaatatcagccttttcatttaaaacatctatctccgtttctctttcatcaacaatgtactccgccatgcagtacctcatctgcacctcgtccccgcgcagcttgaagccgtaattcggacgtgtttccatgacgatgcggtaaggcagcagacgtttctttacttcctttaaatccgtttggagtgtagattttgagataaatagttcttcagcaagttcatcgagcttgagataatggtccgccagcagcagacgtttcataagataggccattctctcctccggcaataccggcaggccctttttttgctgaaattcatcttgcagcagtgttctgaatacttgctcgtcatcaatgcggagcttgtagccggagcctcttacagattgtacaaaggcaccgtggccgcttagcacaccttgaagttcctttatatcattgcggactgtccgcgtcgttacgtttaattgcgcggcaaaaaacgaacttgtcaccggggcttcagccgccatcagcaagcgcagaatatcacgtagtcgcccatgaagcatgagaaaaacctcctaactagtagatgcagggattcagtgaataggcagaaaggatgatgaagggatgcgaaatgtatataaattctataatggagagaatggcaagtcaatgaacatccggaggactagagggaaaactgacctataaaaaaacagccgggatcagccggctgttctagatgcggacatattcttttgtttagacgccttgcggtccttcatgatttttcgaacaatcgggtaaatgaccggcgcccatttgataacggttttgatcatctttttcaaagctccgattctcccttcttttttctcaaccattcccctgattgcctcttccttaaacatgctaacgcgacacgtacctgtttcccgtcacccagaaacgccatggataatcgcgtgcctccccgctgttgtcaatgccgatgcgcgggccggttgaaattgcttccggtgtgtacccgctttcgatgtaaagcggctgttccgtgatccagcgtccgtagtcattcatcgtgacgccaagcgctttcgtcagctttcctggtccgtttgtccattccctcggactcctgcccggccttctctcctccattaacagctggccttcatgcggctcaatcgccctgattaatactgcttgcgggacatcctcttccgccgcaacgacattcagcaatgtatgggtgtgcatcacgtatgtatatacccgcccagcttctgcaaacatgatctcagtccgcttcgtccggcggttgttaaagctgtgggccgctctgtctccagcccccatataggcctctgtttccacaatatagcctgacgctgtgccttcgtctgtttcttttacaagaaggcagcccagaagcgatggggcaagctcaagagcggttttttgataaaacgtgatgggcagcggatttttttctctcgtcacgaatcgacctctccttttaccgatttttgtacattgtaccattcccgaagcagatcaaaaaaaacggctgttttaaaatctttccattcagggaatattgttaccgttcaaaaaaggagggccaaccattgaaagatgatcatcaaaacaagcagcaccaatcaaatgcccaagggagcgaggaagcgttttctcataagacatccgggaaaaacgagtcagaggataccttaacgaataggcaggggcatcctgttactgacaaccagaatgtgagaaccgtcgggaatagagggcctacaacacttgagaactatgattttctcgaaaagatcagccacttcgaccgggaacgcatcccagagcgggttgttcatgccaggggagcaggtgcacatggatattttgaagcgtacggaagcttcggagacgaaccgatttcaacatacacaagggccaagctctttcaggaaaaaggcaagaaaacaccggcatttgtccgtttttcaactgtgaatcatggaaaacactcgcctgaaacattgagagacccgcgcggttttgctgtaaagctatatacagaagacggaaactgggatttggtcggaaacaacctgaaaatcttttttatccgcgacccgctgaaatttccggatcttgtacacgcatttcagcctgatccagtgacaaacatccaggatggtgaacgtatcttcgatttcatttctcaatctcctgaagcgacacacatgatcaccttcttgttttcgccttggggcattccggccaactaccggcaaatgcagggttcaggcgtacatgcctataaatgggtgaatgaggagggcaaggccgttctcgtgaaataccattttgaaccgaagcagggcatccgcaacctgacacagaaggaagcagaagagattcaagggaaaaactttaaccatgccacacaggatttatatgacgcgattgaaaatggcgattatccagagtgggaagtgtatgcacaaatcatgagcgatgatgagcatcctgaactggactttgatcctcttgatccgacaaaactgtggtataaagacgattttccatggaaaccgatcggcaaattggttctgaacaaaaatccggaaaactaccatgcggaagtggagcaagcttcatttggaacgggggtgcttgtcgacgggcttgatttttcagacgacaaattgctccaggggcgtacgtttgcctactctgatacgcagcgctaccgtgtaggcgcaaattacctgcagcttccgatcaactcgccgaaaaagtatgtcgccaccaaccaggaaggcgggcaaatgcaatatcgggtcgatagagcagaaggacaaaacccgcacgtcaactatgagccatccattatgggcgggctgaaggaagcgaagcaggacggaaaagaccatacgccgcatgtcgaaggcgatgtaaagcgtgaagcgattgacagaacaaacaacttcggacaggctggagaaacgtaccggagatttactgaatttgagcggaacgaattgattacgaatttggtgaatacgctttctacgtgccgaaaagaaattcaggatcaaatgattgagaatttcacaaaagctgatcctgactacggaaaacgcgtagcagaagggctaaaaaaggtttccgaaaacaacagcaacgggccgatcggcacaactgaaacggaacaggctgcaaagcaggctgaacaggagagccatccatctaatccgtattaacaacagcgaacagggctttttttgaagccctgtttttttatttttctattgaaacgttttcaacaattgtgttgtactggaaggaaaggggtggagagatacgatggaattacagcaggacttgattcctcagaaaaaaacaatcggcgccttagatcacgccgtttttttatgcatggtattttgtttctggttttcaggctatatttacgttcctgtattcagtctgtatttggaggatctgcacttttcatatggcgcaatcggcatcattctcggcagctacggggtcacgcaaatccttctgcgattcccgctcggccttgtgtcagacatcctgttttccttgcgcaagcaattgttaattgccgggttcggcttttccgtcctcagcagcctgctttttctgatgtttgattctttcttcttcgtgctggccgcccggcttttcgcgggaatcactgcttctatgtgggtgatggcgaccattttatacgcacattatttcaacaatggcaatgcatcaaaagcaatgggcatcatgcagttttttaccgtcatgcctcagtttgccagcattgtgttctgcgggcttgcggcagcccatttaggcaggcaggttcctttttggatggcgctggcagcctcggtcgccggtctggtgatctgctgctttattaaggatccgtctgctcctcccgcaaaccgtgacaccattcgtgtcaatcagtacatcaaagatacattgcagctgccaaagctgaagcttttcaccatcctgtctatgacggcccatgccgtattatttatcacagtattttgttttacgccgctttacatgaatcagctcggaatgggtgacgcggagcttctttgggtgatgagcgcctttttcctcccacacgcagccgccacattaagctttgtgtttctgcgctttacaagccgtatcgcttactccgtgatgctcattagtttcgctgtcaccggggtctgtttgctatatgttcctttttcagctgcattgttcacggtttgcatcacacacgcctgtatcggactggcgctcggcttcgtttttcctctgttgctaagccatgtcgtcgaaatcagttctgcccgattaaaaatgtcagtgatggggttttatcaatcattttatgcgctaggcatcttcctcgggccccttcttgccggaaaaatcgcacagcttgtcgggcttgcgggagttttttatggagccgggtttctggcatttgccgccttttttgtgatgctcgcgcaaaaacgtaacatgatcaattaatagctttcataccgccggaagcgccacacagaaaacacggccagaagcatgatgcacagaatggagaaagtgagtgaccatccgaaaaaatctgcccgctctccatgaagaaggatatgctccgcctgcttgcaaatctcagccggaagccacttcgcaccatctggaaatagtgaaacagcaaaggaaacggctgctgtgagcccgatcccgcaagccgcagctgctccgacagaccggaatatcgtacttccggcaaggccggcggtcacaataaatatcacccaaagcgcgtaaaggccaaggcttgcggcaaagcggctgaatgatgcgtcctcaaacagcagccggacgtaataataagcaagcccgtatccagctgcaaacgacataatgccgatcacgctttggatgagccatttactcacgatataatgggctgccgtcacaggccgcgacataatcagcgctgttaccccttgatttctttcattggctacactgcccatcacgctaaagatgaccagagccatgccaagcgtgttgaattgagaaagcgtgcttaccatcacttcagacccggagggcatcgtaaaactgattttcatgccgtcaggaaggttccctccatgtgcgatgatttccggcatataataaatggtcagcggctgtgtcagcccgacgatcatcatcgcaatcggcagccaaatcagcttgccgcttttccatccttccagccactccttctgcaaaagcgccatcatcaccttcatgcgtgcaccacctttagatagacgtcttctagagactccgttttctgttcaaatcgggtgacggtcaatccctttcggatacagtcacttaataatgaccggccagcttgtatatcaggcagctcgaaaacagcttgggacggatttttatagacaatagctgagacgtaaggcttctcttcaagccagccttccagcttctctttcactgaaagggtaaaaacgttcgtttgctgctgttgtttcagctcctgtaactcgcctttccatgaaatttcaccatttttcataatcaccacttgatcacacacctgctctgcatcgtgcaaaacatgtgtagaaaacagaacggccatatgctttttcagctcccgcatcatgtccagcacctcgaaccgtcctgtcggatcaagcgcagacaccggttcatccaatatcaaaaacttcggtttatggagcagtgcctgtgccagaccgagtctttgtttcatgcctcctgaatagcccccgatctttttgtgcgccgcttcgtgcaaacccacaaattccagcatctcgccgatttcctcttggcattttctcttcgaaaggccggacagtctccccgcaaatgtcaaaaattcatttgcggtcatccaggaataaaaagctggatactgcgggaggtacccaatcaaacgccgatccggctttttttctcctaacagcttaatgtttccggaggttggcgaaagcagaccggccagcatttgcagagtcgtggttttgccggctccattaggtcctaatagtgcgacacactcattttcattcacgtgaaaactgacattctttacagcttcatgatgcctgtacgatttgcataatgattcaatagacagcatatcggcttacctttgctttctgccgacggtaaaaaacaaaatcggcccaataatattgatacatacaatgattgcagcccacatccactttggcccgtttgtccgctcttcttttatacagctgataagggcaaacaccgccaaagccagctgtaatacaatcagcggcaaaatcatttcccaagaaatattcattgcttgatcccccttttcttccgatccggcctaatgacaaaaaagtaataacaaatcagaggcatcggtgcttgaatcaatccgacaatcccccaaacccatgccatgcgattacgttttttcgcatcaataaataaaaagattccctgcgccaatacgatgagacaagccgcaaccgttatgataatttctgtttgtgtcatccgcgtttcacctcgcattcgccgagatgcctttttttctcagccgcaatcaaaatcggcagcaccgcaagcacacaaacctgaagcacaataaacacagcaggagcttgagtgaaagctaagattgcagcactcacaaccatcagcgcgcagaatacaaataaaatgatctcttgaagaagtttttttctgtattcagctttcatttgtgacagctggtgaagcagttctttttgattcggtatagagggattggctgtttgatcaatttttttccattctgactttaaatgatcagaaagcttttctttattcatcgtcccactcctttctgatttgctggagccctttatgaactctggactttacagtgccttctttgatttgaagcatcaccccgatttcagcgtaggtatagccgtagtaatgccttaataaaaccggtgtgcgcagtttagggtccagctttgaaaacagatcgagcgtttcgctccactctgcccctttcgccgacacgtcccacttgatcttgcggattgtttcctccgtaactgtctgattccgtttccattctctctttctctttttctgatgatcgagatagagccgcgatgcaatggagatcagccatgtggagaattttgaacggccctgaaagcttcttaaatggatgtaccctttcagaaaggtttcctgaacaagttcctcgctgagatcggggtgaagggaaagctttaacaagtatttatataagaaagaatagtgatagtggaaaagggctgtaaacgcctcgtcgtttccctctttcgcctgctggatcagccgctgttcttcatgtgtatccaatgaccgtgatccccccttttttgtttttctgccttatgagacgacaccggattcaaaagcgttcatcttttttacaattcttttcagccattgacagatcaggcttcccggccgtttggctgcatatccttatttgtaaacccccttatagtctgttaagctatgactttatgtcgatttcaaaaaaacatccaatatggaggacgatgcattgaaagtagaaaggcgaacgattgaatatattccgaatgaagaaagacatggtaaagcgaaagatttatttcccgtatggttcggggctaatatgcatatcaccacgttagtgaccggcacgattcccgttgcaatgggacttaatctgttttggagtgttgccgctattatttgcggaaccttaatcggtgccatatttatggcgtctcattccgcgcaaggccctcagctaggcatcccgcaaatgattcaaagccgtgcccaattcggcgtaatcggagcgattcttcccctcttcttagtcatgtttatctaccttggtttcttcgcaagcagcacgattctggcggccggaaccttaagcagctttgttcccatcccgggatcatggagcattataggcttaagcgccttatgttttttactcaccattttcggccatgatttgattcacaaaatgcaaaaaatcctttcttggacctcttttgctgtattttttgctgcaacgattctcatttttcaattgccgattccggcaggcagctggattcccggagcgattgatctgccaattttcttggtggcagtcagcgcagttgcgacgtggcagcttgcctacgcgccatatgttgccgattattcaagatatctgccagttaaaacaccggcttcaaaaacattttggtacagctatgcaggtacatctgtcagctccatctggatgatgctgctcggcgcattgctgacaacctcacttcctgactttacggcaaactcaggcagccagattgtccaattgttcggtcccttctcgtttattatgctgatcattgtgttatttgggcaaatggcgatcaatgtttttaacctgtatggggctttcatgtccacgacaacaacgctggagccatttctgaaattaaaagtcacgcccaaagtcagaatcatcatgatcctgggtgtcacgcttgtcggcacagtcttaagcctactgggacagagcaattttatggagctgtttttgaattttatctttttcatcagttatttcttaattccgtggacggcaatcaatttagtcgattactacttcgtccgccacggaaagtatcaagtcaaagccatgttcgacgtaaacgggccttatggaaaggtcaattggatcaccacaattgcgttcgtgctgtctatcttgctggaaattccgtttatcaatacaagcttttacatcggaccgcttgccaaaatgtttggcggcggagacatcgcatggattatcggcttggccgtgccttctgtgctttactatgcattaatgaaaccgcgtctgaaaaaacgggcggggtatcaagaaaagctgtcttctctctgaagacagcttttttatcattcaaatcgtttccacacgcggggcaggatgtcagatagctcatgagcgagcaacgtatgagcggagtgctcgtccgtccagagctcggcgcacgcaccatgcaaatagaccgcgtttaatatggcgtgctttggatcttcatggcagcagagcatccccaatatcatgcccgtcagcgtgtcaccggttccgcccttggcgagcgccccgtttccagttggattgagccagcagtctccatcaggaaacgcgatgacggtttggtttccttttaacacaatgacagtctgcagctgagccgcccattcctttgcatattccgctctttttttctgcaattcgttcacgggcacccctgtcattcgggaaaactcgcccgggtgcggcgtgaggatgacgggggcctcccgtttcggatatgtgcgcttcgccagcgctccggcatccaaaataacaggacaatcagccgtaagcacatgatcgactgcctgctgtacgctttccgtttgcggaaggcccggtccgatggcaatggcccggtacgtctcttcaagctgagcatccgccgcctttttccagccgtcacgccaataggtcgcctcgggcaaaacaggaacaattagcgggattacgctttctgatgtaccgatgacaagcttgccgagaccgctccgcatggccccaagccctgcaagcagcgctgctcccggcatgtcgtcacttccagccagcagcaaagccgtaccgtacgtgcctttatggctctccgcatctctttcaggaagcgtggcccttacatgctcttccgtccaaaatggaacattcatctctatccctcctctgctttcttttcctatttttcctgtcccttttctttttcaaacaaaaaagacagccttttagggctgtcttttattttacaggaacatcaaggtgatacaggcggcgatatcgttcgtttgccgccagcagctcctcatgggttccttccatttctgttttgccgttttcgagaaatacgattttatcggctgcttccactcccgcgagatggtgtgtaatccataaaatcgtttttcctttcagcacctcaaacaccgtttccatcaattcacgttcggtaataggatcgaggccgactgttggctcatcgaggatgatgatcggtgtatcctgcagcaaaatcctcgcaagtgcgatccgctggcgctctccaccggaaaaacggatgccggtttcttgtacagaggtatgatatccatcaggcaatgactcaatgtagtcatgcagcttgacctgctttgcggcgcggcgcacatcctcgtcgcttgcttctccgtttccgagcctgatgttgttcaaaatacttgtatcaaacaggtgcggtttttgatttaacacggccaccgcatccgcaatctgatcctttaacagcgctgtctccactccgtttaacgtcacagaaccggagtccggtttcaaggcgccttcgattaatgcaagcgatgttgatttcccagagccgcttcggccgagcagcgccattttttctccttggcgcagcgtaaaggaaaagttgtgcagcacttggctgctgttgtcataagaaaacgtcacatcacgaaaggccaaggtgacatcttgaagatcgagcatttgatcccctgattcagtttgtgacgcctccagctgaggagccaccttgttcatgcgtctgatagaatcctgatagcccggcacttcgcctaaggcatccgaaagcggcaaaaaggcttccgtcaacggaaataccactagcacaaaagcggcaatcatcgttttagcgagctcgccgtccgcttgctgtcccgctgtccaaaacagcatcatcaaaataaggccggcgacaaggcattgcgcaacaaagtcccgccatcttgtaaagcattgttttttccgttcaagctcaaaccaatcatgttcctctttttcataagcatcaataaaagcatgccggcgtccgctgaacatccagtcgctgacacccatcacagcatctgtcagacggctgtacagcgcattccgtccgcttttcagcttcgcattcttcgctctcgtcacgagcaaagacacaaccggaaacaatacaacaagaacaaacaaatacagcgcaagcaatatggcaaacggccaagagaagaagccgagcgctatcactgacacagcatacaggagcaaggctgagatcgcaggaaaaatcgtttttaagaatgcatcctgcaaatgctcaatatcctcagacaaaatgccgagcatatcccccgtgcgaaaacgggaacgcagcatcaaagcacccggctcaagcatattgtaaaggcggacgcgcatgtcggatacgattttcaaaatgatgtgatgcccgacaagccgttccacatatcgcgacacagaccgcgcaatcccaaaagtgcgcactgcgacaatcggcacataaatgagcagaatgttttccggccttgtcgccgctttagaaatcaaaaacccagaggtgaacatgagaaaagcagcagaaaaaatcgtcaccgcgcccaaaaagataaccagaacaaacaggcgggcattttgcttgatatacggcaaaatccattcttctttcttcatgctctttcccccagttgtgccttcacgagtttggtatacacaccgtttttctccagcagttcattgtgagtcccgatttccgcaatcctgcccccgtccagcacgataatttcgtccatatcgagcatccagtgaaggcggtgagtcgcgagaaagacgagcttatcctcaaataaatccagcatcgtttcttttatttcatattctgtttcgatatcaagatgggcggtcggctcatccagcagcaggatcggacggtttcccaaaaaggcgcgggccagcgcgacacgctgtgcctggccgccgctgagcgcccggccgccttccccgatccgcccctctaatccttgaggaaggctatccaccagctccgccagtccagctgccgcagcagcacgggctgtatcctctgccgaagcgcttggatggtagaagcgaatgttgttgccaagcgtatcatcaaaaatgtacggatgctgtggaatgtaaagaaggttcttctgccagctgccgtcctgcaaatgggaccggcttgtaccattaacctcaatcatcccgccatccggctctaaaaatccgccaagaatatcaattaatgttgattttccggcgccgcttgcaccgataataccgatttttttcttgcccttgaatgagagatgaatatcagacaccgaacggccgactgacacgcctgacagcttcagctcatcctgatcagaccaagcctcgagctgaagcggcgtctcttctttaaaaccaggctgcgacaaaatctcttgaatggtttttcctgcttcctggccgttcagcgttgcatgataatcattccccacttcccgcaccggcaaaaaatactcaggcgccagaataagcgccgttaaagcagggccaagcaaaatatcgccgtcaatgaggcgcaggcccagaaatactgcgactgtcgccaccgacagcatcgtgaaaaaatcgagggcgaatgatgacaaaaacgccacccggagtgtgctcatcgttgccttgcgataccgctcactcacatagaaaatatttttgctgtgtgacttgctcaaacctaggaaacgcaatgtctccagcccgcgaagagaatcaacaaaatgattggaaagtctctgataggatttccactgacgatccgcttttctctgcgcgacaaggccgaggagaatcataaagatgatcagaatcggcatagcagcgactaaaatgatggctgatgtccgatcctgaaaaaacacataaatgacaactgccgcaggcacaatcgccatgctgaccattttcggcagaaacagctccaggtagcggcggaactggctgatgcctcccatcgccagcgtcaccatttgccccgtcccctctttctttgcaaagcgggggcctaatcggaacagctgatcaagaaaacttttcctcaaatctgctcctgtccgggcggcgtattgatagacgattttctgtcgcgccaccgtcaccccgtgccgggcgataaaagcgatgaggaaaaagccgatcatcggaaaaagggaggtaatgcccttcccgttgaacagtccggttacggcctcactcagccactctgcctgcataataatggcggctgtctgaatcatcgttaaacaagtaatcaaggtgagaatccgcttcattcctttatatcgaaacaggtcttttcccattaataagtcataggctccttatggctgacgcgcttccggaagacataatagctccagatctggctgccgatgacgaacggcaatagcgttaatgctgcaattgacatgactttaagcgaataatctccggaagaagcgttagctactgttaaatcgtatgcgctatgaagcgagctgaccattacgcgagggaatagggaaataaagatcattcccacggtcagcgccagaccagcgcctgtcatcccaaatgtccagccgtcttttttcttacgaataaatacagccgcgagcataaagcagatgacaatcaaaacagcgagcggaatggtaatctcgccgcggcgtgtaaacatgtctgtctgatacgcagaaagggccgcgaaggcaagaaccgctacaaaaacaacacccattatcttttgcgccattttccgggcgcggttttgcaaatcaccaatcgtacgcagcgtgataaacattaatccatgctggaagcaaagaagcgttaccgtcacaccgccaagtatagaatatacattgatataatcagaaacatgtgcgtgaatgttcatgtcggcatcaatcggcatcccgcggaataatgtcgtgaacagcacaccaagcacaaacggaggaatcagactgccgaagaaaacgacccagtcccaaacctttacccattttaaatgatccaccttgccgcggaactcaaacgcgaccccgcggcccattaacgcaagcagcactatgacaaacggaatgtaataaccgctcagcatcgttgcataccagtttgggaatgccgcgaaaatggcgcctgcgccagtcaaaagccacacttcattcgcgtcccagaacggcccgatcgtgttgatcagcactctgcgttctaattcattatggccaagaaaacgggtcgccatgccgaccccgaaatcaaagccttccaaaaagaagaaacctacaaacaatacggcaacgagtataaaccaaagatcatgaagagatgccatggtatacctcctgactaaatggatctgttgatacaggaacatcatgatgatcactatgctccgcaccttttttaatctcacggataaacaagaagacaagcagtgcaccaagaatcaagtacatcacaccgaatgcgatgattgagaataacagggagcccgctgttacattaggcgacacggattgagcggttgtcattaaccccataaccgtccaaggctgacgtccgatttctgtcataatccagcccgcggagttcgcaagaaacgggaaggaaatcaacgcgatcatgatgcgcaaataccatttgctgttttcaagctttttgcggcggtttaaccaaaggccgcctaacgcagcaagaatcataacaacacctgctcctaccatgatgcggaagctccagaatgtcgttttcactggcggaatgtagtcgccttttccgtatattttttcgtactcagcctgaagggttttcatccctttgacacttccgctgaatttctgataagccaagtagctcaaggcataaggaactttgatttcatttgagcttttttcattttttgtatcgatcgtcgcaaaagcggtccaagcagcagggtcaccgctgtcttcccatagaccttcactggcagccattttcatcggctgtgattccatcaagtgctcagcctgcatgtgtccgctaaggccgacgccaagaccggcacaaagaccgacgatcattgcgagtttaaaagattgcttaaagaacggcacttcttttttcttcagcagtttaaaagcactcactccggcaataaagaaagctccagtggcaagcgcaccgaaaataacgtgcgggaattcaacccaaagctgagggtttgtaatcaacgcgccaaaatcattcatttccgcgcggccgtttttgatcgtaaaaccgaccggctcctgcataaaggagtttgctgttaaaatccagaaagatgacatgatcgttccgaatgatacgagccatatgcagagagcgtgaattttcttcggcaggcggtcccagccaaaaatccataatccgataaaaatagattccatgaaaaacgccaataatgcttcaatcgcaagcggagcgccaaatacatctccgacaaaacgggagtaatctgaccagttcagtccaaactggaattcttgcaaaatccccgttacaacaccgactgcgaaatttattaagaataagtgtccccaaaactttgccattttgagatacagttcatttttctttacaagataaagagtctccatcaacgcaaccataaacacaagcccgatagacatcggcacaaacaagaagtgaaacaacgttgttgatgcaaattgtatgcgggctaataccaattcactcatgctttctcctccatttccggttaaaactgttaatttgctcactacttcacaaatagaaccgagactttgatcagtaattcacaaaatagacgaaaaaaatattgttcaatatttcacaaatgtgtcaaaaagtcgtccaatatgagacaagattgccagactgaccaaatgacacaatctctgactggttcatattaagtactttacaacgattcatttcaaaaataaagcctaaaatacctaaaaagtcccgccctatgtgacggatttttgtctattttgttgcttatttatgtcggctgctaggataaatgaccctttattatcgtacatcaacacatcgttccttgcgaacaaaatgcttgccctgcaccagcactcgtttctcagcactccgtcataaacagattttaggcaggatgcctcttttcatttgaaccggcaagtggagaaaagttgaatagtaaatttttaatatattaataatttcaattttttagtatacttaacatagtgaacaatttcactgcatcaagaataggggaggtttttcaatgggagagcttcaaacacacatgcaattgcaaacggatacaattcacgaaggggttcgaaaagagaattggtttgcgaaagccatgaatataaaagtaggcatcataccgcttcctgtgtatgccttgctgtttatattaatcactgtttttgttatgcatcacgatgtaaaaagtgacattttgacatccattgccgtcatggcgtttttcgggtttacctttgcccaaatcggcaaatcgataccgattgttcgttctatcggcggcccggccatcctagctacttttattccgtccgctgtcgtgtactatcacctgctgcctaatgatatcgtcaaatccaccacagaatttacagaaaactcaaactttctatatttgtttatcgccggtattgtcgtcggaagcattctcggcatgaaaagagaaacactcgtaaaagcattcatgaaaatctttattccgcttattgtcggatctgtcacagccgctattgtcggactggctgtcgggacattgctcggactcggatttcagcataccctgctgtacattgtcattccgattatggctggaggagtcggagaaggcgctatcccgctgtccatcggatattctgacatcatgcccatttctcaaggggaagcgtttgcacttgttctgccatcgattatgctgggcagcttgtgcgcgattattctagcgggattgctgaaccgcatcggaaagaaaaaaccggaatggacaggcaacggcaaagtggaccgctccgaagaagagtcccctgcgctggaggaatctcaaagcggacaacaaatgttcaacctttctttatttgcgtcaggcggtatccttgctgtttctttatacttagtcggcatgctcgctcacgattttttcggttttccggcacccgttgccatgctgttactggctgttctaatcaagctgttcagattggtgcctgcctcaattgaaaatggcgcgtttggagtgtcccgctttttttcaacagctgtgacctacccgcttctctttgcgattggggtatccatgacgccgtgggacaagcttgtcgccgcttttaacctcagtaatattattacgattctgtctgtcgttgtgaccatgatggccgttggcttcttcactggaaaatggctgaacatgtatccgattgaaaccgccattatcaatgcgtgccattctggacaaggcggcacgggtgacgttgccattttaagcgccgctgaaaggcttgagttgatgccgttcgcccaggtatctacccgcatcgggggagcgatcacagtatccttaaccttattgctgctgcaccagttttattgatccccgcaagcaagttcttcgtcaaacgaaagagcttgcttttttgcatgtccatatttttgcaagttcccatcccatgctatagtaatagttggaaatactagatagaaaggaatctggcatgcctatgggaactcatctatttctctttatgcttctcgggctgggattttatttgatatcagccctagctgcaaaactcattccggccatagacttctggattgatattgttctatgggtcggcgctgcagtttacatcttctctcatctctcattcatggacggcattgtctcactcgcgacaatgttctactgctattggaccgcaatggatctcattgtttcagagcgtgtggaaaaaccttcgggagactggcaggaaatcgagctggccagaaacaaaacacgtctcctgtcagacattacgctgaccgccattgtgtttgcaggggctgttatttttttcatctatggacctgacccaagccctctcaaatatgtgatccttctcggcatgatctccggcggaggggcactggtgaagcgtatactgaatgttttcagcgtaaaggttttttattcagcagccttagaaaaattgcatatcagctcacactatgaaacccgtacatacccgctttccgatttgaaggacattcagcttgaatcaacagctgatctcttaaagctccatccgcttctgacgatgtattcatcacgtttagatttgacaacaagctttcagcaagtcattaaactgtctcttcccggcgaaacactgtttctgacggtgaaggaaccgcaaaaatggaaaacaattcttcaggaatacacagatgcaaaaaacaatgtggacaatgtgatttctgttttgccgttttatcatagaaaaaatgtgaagcggctgctcgggaagctttattttgccgccagcgtaaaaggggtatccgcttacgccttattggtgctcgcgttatacgcatcacacgcctctccatgggtcatggctgttgccgtaatcctatattgggtattcaacatgtatatgtcagaccgtgtgttgcgggcagcgatggacgccaagccttgtcatcatccgcatgtacaggcagcggccgatatgattttccgatcggccggcatttcccatgtccgcatatacgaaacggagagtgatgattacaacggaatggcagtaggcatgaatgtcgggaggtcaatggtcatcctgacaagcgccacactaacacttccacagcgtgtcatcgaaggcattctggcccatgaggcaattcatatcaaaaaacgtgacgttctgtcatcacagcttttgcgttttctatatcttggagctgtcgttgggattttcctcttgtttgagcagcatatcacccatcccgaggcccacaaaattgcgctttgggctttcattatggcaatcattatcctattccagctctatcaatccttttgttcacaatggatggaggtgcgtgctgacaaccttggcgcatccttgctggagggcggttacaaacaaatggctgaagccttgaaaatcttggcggttcagcaggatgaggacatacagaaacaaagtgcctacagctctgaagccggtgaagacgagcttcaaattgactctctcacccgtgataaaagctggtttttcagattgattgattttcagttcgctcctcatccccctatgtattggcgtgtcggcactttattgtcaaacaaaggacatggggtgctaaagcgctggctcagagaccgcctgaaagaatcgatcactttgaaatgaaaccggtcagcgtttcatccgtataacagatatggtgaaaaaagggagtgaccagaagtgatagtgatcttattgataatagctattattgtttttctttcagtcattcagccgcagccatcggataataaaatccgccagcaggcggacagcgggtatttcggttattcagatcatagctcgcaccatgatggattcggcagtgacggaggtttcagcgattccggctgtggcggcggagggggcggcgattaaacgccgcctttttttatttcattgattcgatgtacgcaccaaaagccgagcccgacatgcctggggacacgcgcacacgatggagggcatacattccctggtctctcgaagccgcgcccggttctgtcgtcacgcccatttgatagcctgttttttcagcggccttcagcgtctcctcattgtagcgccctaccggatagctgatgatggtggtttgctgatgaaacatgtggtcaaacagctttttcgaatccgccatctcactttgctgctgttgaggcgttaatccgttcagctcaaggtggtcaatcgtatggctttcaatcgatatgccgtgctgtgccatttccttcatttgttcctctgtcagatgatgcttatgtccgatcgatttgccgatcataaaaatcgttgccttcatcccgtactttttcagcaccggatacgcatcttgataattgtcggtgtacccgtcatcaaatgtgatcagcacgcacttctcactcggttttttatcctgcgtcagcatgagatatgcctctttcggcgttaatgtctgatagccgttatcatgaagccacttcatatgcgcctcgaattctttctttggcacacggaggctgtttcctgaagaaatgctgtggtacatcaaaatcggcagctttgccggtttctctgttttgatccatgcggatgtatcgtcttcttttttctgaacttgtactgcctttttttccggtttcttttgttccgcttttggcatcggctgctctgcattcgcctcttgatcagcgcaagccgcaagagccaaacagctgcccaaaagaaagatgcttaaaaacaatcgtttcatcgttctcctgctttctgtctatttcttcctcctttttcatcggtttgattctgagattttcaatagcaaaaaaccggacatgtctccatgtccggtttttttgatcctattgaattctcacttctgtctcactgtcaaagaaatggcctttattcatatcaaatgcaaccgtcagctcatcgcccgattgaatatcgaggcgggcgtcgatccgcgcaataaagtcttggttgtctatctgcgaataaatcataatttcagaaccgagcagctctgcaacattgattttcgccttaatcgaagagttcttatatgattccacgacaatcaattcatcatgtatatcctcaggacggatgccgaagatgacctctttgccgatgtagcctttttcacgcagcactttcatttttccttccgggacggttaatgccgcagaaccgattttgattaagccatccgtgagctttcctttgaaaaaattcatcgccggtgatccgataaacccgccgacaaagacgttttcagggaattcatatacatccttcggcgtcccgatctgctgaattttcccatctttcatgactacaatccgtgtcgccattgtcagcgcttctgtctggtcatgcgtcacataaatcgttgtagtctgcaatctctggtggagcttaatgatttccgcccgcatttgcaccctcagcttcgcgtccaggtttgacaaaggctcatccatcaggaacacctttgcatcccgcacgattgcccggcccagcgcaacccgctgtctctgtccgcctgacagcgctttcggtttacggtgcaaatattcctccagcccgagaattttagcagcttcctctactctttttttgatttcaggcttcggcattttccgaagcttgagcccgaacgcgatattatcgtagaccgtcatatgcggatagagcgcgtagttctgaaataccatcgcgatatccctgtcctttggcgctacatcattgacccgttttccttcaatataaaaatcgcctttcgaaatttcttcaagtcctgcgaccattcgcagcgtcgttgatttcccgcagccggacgggccgacgaatacgataaattccttatcggcaatatgaaggttaaagtcatcaaccgccggttccttctgatcataaaatttataaatgtgctccatccgcaattcagccatctaacatccccctttgttattgtaaacgctttcttatattgagtgtaacagcaattccctctcgctaaaatgggcagcgttcataaaatcatccagccatttttcgtgcatatttccaatttattctgaactttcattttgcaggcagataaaataggcaagaagcgcgcctttgtacgatttgatatctatccctgaccgctcaataaatttatcaatccgatattgcaggctgttgcgatgcagatgcagctttttcgctgttaatgtgacgtttgagttgttttcaataaacagcttaatggtcttccttagctcagcttcacttccaaataaaagctcagcttcttcagagagcagcgtttccagtttttctttttctgtttctaataatagaaaaggaaagatcatctcaaaggtcacactctgcacctgaggcagccgtttttcagcaaacaggaaatacgcctgttcacgagtgtaatgttttcgcagacactcatccggctcgtaaaatcttccggcgtaaaaacggacactgaagtagaaatcactttcaagaacttttgcgagcgattccagttcgcccttcttcgccgccgcttcactttcctgctcgacaatcacgcctctgtcctcatgaatccacacaatcacaaaagacaccggccaaaaatggcgaaccgcttctgtaaaggacgtcctttctattttgccgaataaatgaaagtgaacaaatctcgtccgtttctttatgtacgccggcaattcccctctggaaaaaaggaacgaaaaccacttgttttcctcaggtgatttcatagacagttgattgccctcatccgcaggcgtcaaaaatgattgcagcaccaatacttctttttcactgatctctgttttcggaatggagatatacctctgattgctctcatcaaaaaaacatagacagccttcccttatgcaaagctcctcagacacaatcgaaccgggataaatagccagcagcgatttcatagagtctcctctcttatgtaaggatctgtatattcagtataaggcgaaacacacatgttctccactaaaaaagagtatatccggtatagatagacgagaaactgaaagggaaacctcattcgtttacatattggcttcagcggaaatagaagaggatatgcaggaccaaaggagggccatcttatgagtttcgaaacgttaaacaaaagttttatcaatggaaaatggactgagggagaaagcggacgtacggaggacattttgaatccgtatgaccagtctgtgatcacaacagcatctttggcaacgggcaaacagctggaggatgcgtttggcattgcacagaaagcccaaaaagagtgggccaagagcacgacggaagaccgaaaagccgtcctgcaaaaagcgcgcggctatttacaggaaaaccgtgaagacatcattatgatgatcgcccgcgaaactggcggaacgatcattaaatcaacaatcgagctggaacaaacgattgcgattttagatgaagccatgacgtatactggtgaattaggcggcgtcaaagaggtgccatccgacattgaagggaaaaccaataagatttaccgccttccgctaggtgtcatttcatcgatttctccatttaatttcccaatgaatctatccatgagatccattgcgcccgcaattgcgctgggtaacagtgttgttcacaagcctgatatccaaactgctatttccggcgggaccatcattgcgaaagcgtttgaacacgccggtcttcctgccggtgtccttaacgtcatgctgacggatgtaagggaaatcggggacggcatgctcaccaatccaatcccgagattaatcagctttacagggtcaacagcagtcgggcgccacatcggtgaaatcgccgggcgtgccttcaaacgaatggcacttgagctcggcggcaacaatccatttgccgttctttcagatgcggatgtcgatcgtgctgtggatgccgcgattttcggaaaatttattcaccagggacaaatctgtatgattatcaacaggatcatcgttcatcaagatgtatacgatgagtttgtagaaaaattcaccgcccgtgtcaaacagcttccgtacggcgatcaaaccgatccgaaaaccgttgtcggcccgctgattaacgagcgccaaatcgagaaagcgctggagatcattgagcaggcaaagacagacggcattgagcttgcggttgaaggaaaacgcgtcggaaacgtgctgacgccgtacgtctttgtcggtgcggacaacaacagcaaaattgcccaaacggagctgtttgccccaatcgcaaccattattaaagctggcagcgaccaggaagcgattgacatggcaaatgatactgaatacggcctcagctctgcggttttcacttctgatttagaaaaaggcgaaaagttcgccctgcaaattgacagcggcatgacccatgtcaacgaccagtccgtcaatgattcgccgaatattgcctttggcggaaacaaagcaagcggtgtcggccgtttcggcaatccgtgggtcgtcgaggaatttaccgtgacgaaatggatttcgatacagaagcaataccgcaaatatccgttctaaatgaaaaaatccctctgtttcaagtacagagggatttttctttatttagatatatccacaaacccttcgccaaacacatcgcgtacgtcatgaacgatcacaaacgcttttttgtcgcagcttctaatgatttttttcagcatagacagctcctgtttgttaatgacgatatacaaaatctcttttgattggcccgtataatttcccttccctgataaaatcgtcacgccccgatccatcaaggtattcacctgctctgcaatctcactcttattttctgaaatgaccgtaatggcttttttcgtattcaaaccttcaataatgaagtccatcactttggtaccgatatacagcatcacgatcgtaaacatcattttttctgcaccaataataaaataagagctaaatactacgattaaatcaaaaaacaagagtgcatagctgatattccagtctaaatatttattagcaattctggccagaatcgcggaaccagccgtcgtcccgccgacccggataatcatgccgatcccgactccggcaaatacacctgcgaaaatcgtattaatgatcaattcatcagacggaatgctccacccatgtgtcagatgaagaaaaagcgaatttgccgcaaccgcaatgatcgtataaaccgttgtttttccatccagaaacttgtagccgattaaaagcaaaaacgcatttaagataaagttcgtgacaccaggagaccattgaaacagataatacaatatcagcgtaatcccagtgactccgccttccccaagatcattgggaatcgcaaataaattaaccgcaagcgcgaagaaaaaagcgccaatcacaagcataagtacatccagcattctctttttcatcacgaaaacactccttctcattgttctgttctactagcaaataaaaaaacccaggagaacgctctcgaaaaagagcagaaactcctgggcttttatcccaccgtgtcataacagccaatctgctatgtgttttctctcggtcacagtccaatttgcattgcggaaccctagaaaaccactgtttttatcatatccttttcactttccaatattagcattataagggacggttcgaattggttcaaggggtatttgcggagttttcatcagataagctggaagaaaaaacgatttatctattaaaaaagaacagatataaccgataagaaaaaaagcatatattttacaagtaaatgtaactataaatgataataattatgagaaattcataattttatattgactaagtgaaataatataggcattatagtacatatgtttcgtacattttattacataggaggaaatataatggcaggaaaactagtaccctgtaaagcttgcggtcaagaaattgcaaagggtgtaaaaaaatgtcctaactgcggtaaggatcaacgtaacttttttatgcgacataaaatcattacgtttattctcgcagttgttgtcatcattattatcggtaatatgattggcggcggaggcggttcagaagccacttccaaaacatcaagcggaagcaaagcagaaactgaaaaaacatacaatatcggtgatactgtaaaaactgaaaaaactgaagtgacagttacgaaggtagaggacagagatactgtcggtactcaatatgttgaaaagaaagcatctgatggtggtacaattgtagctgttcaatatacaattaaaaacgtatctaaaaagccaataagttctttttcaattccaactgttaaattagttgatgctgatggtacttcttatgattctgatattgatgcttctgtaaactatgcaactgagacaaaagttgataactctaaaattttgagtgatctaaatcctaatattaaagtaacaggtgtaaaagcatttgaagttgacaaggaagcttatgcaaaaggcacttggaaactaaaattcagtaatgatgttattgtgaaaatcaaataacagctaacaagggtgcctgttcaggcacccttgttctttaaaggccttctctattgagaaggcctccattcttattccgcactcttatacccattcacattagaagactgccatctccaggaatcagcacacatttcctcaaggccgcgtttcgcttcccagcccagttcccgcttggctttcgcaggatctgcaaagcatgtggcgatgtctcccgggcgacggtccgcaaaacggtacggaacctctttccctgacactttttcaaaggctttgaccatttcaagcacgctgtagcctgtgcctgttccaaggttgtatgcatcggctcctgtagagttcaatactttttccagcgccttgacgtggccttctgcgagatcaacgacgtgaatataatcgcgtacgcctgtcccgtcttttgtcggatagtcatttccgaatacgcttaattgctcaagcttcccgactgctacctgtgccacatacggcataaggttattagggattccgttcgggtcttcaccgatccgtccgcttggatgcgcgccgaacgggttaaagtaacgaagcagcgcaacgctccactcattgtcggctgtatgcaaatcacgcaatatttgttcaagcatgagcttcgtctgcccataagggtttgtcgcacctaatggaaagtcttccgtaatcggcgatgtttccggaacgccgtacactgtcgcagatgaactgaatacgattttcttgacgccgaatttctccatggcctcgcataaaataaacgttcctgtcagattgttatgataatatttgagcggaatcgccacagattcaccaactgcttttaacccagcaaaatgaatcacagcttcgatttcattttcagcaaaaaccgcatctaccgcttcccggtccaataagtccgcttcgtagaacgttaaatcttttcccgtaatccccttgacacggttcagcgcctcagccgaactgttggacagattatcaagaacaacaatctcgtagccgctgttcaataattcaacacatgtgtggctgccaatgtacccggcaccgccagtaacaagtattgccatgatgtaaccctcctaaaaaatgacctgttttcattatatagtgtttaaaaccggtccacatccatttttaagaagtttaatcgtttattaatagttttttcatatattatcagcattttcatacctttatgcagcgtgaacaagtatagcagctgaaaaatcaatctgccggttgacgtttttctttccctttttcgctatgcttaatgtagaaaggatttgatgacatggcgatgagcccatatatttttattgtattgattcttattattttatcgatgtaccgagagagagctgtcagacccgggaagttgctgatcattccgctgctgctcttatggggcgtatcagcatcgtttcagccggcgtattttcattccgtattacatgtggcgatcagcggcattttattattaatcgggctggcctgcgggtttggcattggaaagatggtaaacgtgcggattcacccggaaaccggaaaggtcacttcacgcggctcacttgggagtgttatcctcattctagtgatactttctttgcgcatggccgcgagaacatggctgcctgagagcaacgagatgtttattgccattattcattctatgttcttcattcccctcggcaccattacagcccgtaacattatgctttataaagcatacagacggctgaccgctggcaaggtatccattcaataactgaaagaaggaccagcatgaacagacaaactccggctcggcactactacaagaagcttgtgccgagccttattctcattttgaattgcatacaatttttatctcacccagccaaagctgatcccattttgttggcatttgtatttgcggtgtacttagcattcatttgggtcattccctatgtggcatccactgctgttagtttgtgcatattcatcggactctggctcctgaccgatttcttttgggctgtttccggccaagagcagggtgccgcctattttttgattgtatttttaatgatatatgccgcctttagactcccttcacggctatccttgatcttcacagcatgtttaattggaggcaacatattactcctatcctcacaagggggaagcttgaataccatcatcagcaacatctcgatcatgctcgggctgtacgtcctcttctcctccatgcgtttcagacgagaagcgagaagggaggctgaacggaatcatgctgaattggcaaaaatgcatgtgcagctggagcatgctcataaagaactccagaaagcgcatgcagagctgcaggaggcttctgttctttcattaaggtacgcggtccttgaggaacgtacaagaattgcccgcgacattcatgacagcatcggtcacgagctgacttctgttattgttcagcttcaatcccttccctatatccttaaaagcagcaaggaggattcagaaaaagtcattcaaaatgtactgagtgtcgccagggaatgtcttcaagaagtacggtctgtcgttcaccaaatgggccgtagtgaatcgatggtggggcttaccgctttgcgggggctcattcatcaagtggaggaacggagcggcttgcacgtttctttagatactgccggactatcagaagagtcttggcctccaaacgtgagcgaaacgatctaccgcatcttgcaggaagcgctgaccaatatcattcgtcacgctgacgcttctcatgcggcggccgtcatttctaacgacaagtcccatctctatatcacaatcaccgacgacggacaattcaccggcagccttacttatggatttggcctgacaggaatgaaagagcgcgcagaaaaagcaggcggttcccttactttcagtgccgtacagccgagcggcctgaaaattgagctgtcattgccgctcatgacaacgaataaggagcaaaaagatgaacaaagataacatacgcgtcgcgcttgccgatgatcagccgcttgtgcgtgaaggcttccgctacgtcatcaacgcacagacggatatgacggtttctggcgaggccggcgacggtcacgatattatagcactcgcaaaacaaacaaaacccgatgtcatcctcatggatgtccagatgccgcgttgctcaggcatcgaagcagcgaaagacattatgtccgcacttccagatacaaagatagtcattttaaccacctttgacacggaagaatacgtatttgaaggcatccgtgcgggagcagtaggctatctgctgaaggatacacttcctgaagagttgatagatgcgattcgcgctgcggccagaggcgaggcgattttccgtacagtcacagctgctaaaattatcagtgagacatttcaggcgaagcaacagccccatccagaagaactggcagagccgttcaccaaaagagagcttgaggttcttcagcaaatggcctacggactgagaaatgaggatattgctgaaaagcttttcgtcagtgaaagcactgtgaaaacccacgtgcaccgcatcctgcaaaaatgcaatgcccaagaccggacacaggcagtcgtttttgccattcgaaacggtattgtgcaatagaaatctctcatcccgccatgctaaaataagacaaaggagatgattggaaatgaaagaagaaatcattgaacggtttactacatatgtaaaagtcgacacacagtccgatgaatccgttgacacttgtccttccacacccggccaattgacattaggaaacatgctcgttgatgaattgaagtccatcggcatgcaggatgcagccattgatgaaaacggctatgtcatggcaactcttccctccaatactgaaaaagacgtgccgacaatcggctttctcgctcacgtcgacaccgctacagactttaccggcaaaaacgtgaatccgcaaatcatcgaaagctatgatggaaaagacatcgttctcaacaaacagctgcaggtcaccctgtcacctgatcaattccctgagctgtctggctataagggccatacactcatcaccacagacggcactacccttctcggcgcagacaataaggccggtatcgctgaaatcatgacagccatggattacctcatcaaacaccctgaaatcaagcacggcccgatcagagtcgcctttacgcctgatgaagaaatcggaagagggccgcacaaatttgatgtgaaacggttcaatgcttcctttgcctacacggttgacggcgggccgctcggcgagcttgaatacgaaagcttcaatgccgctgccgcaaaaattacgattaaaggcaacaacgtacatcccggcacggcaaaagggaaaatgatcaactctgcgaaaatcgcgatgaagctgaacagcctgctgccggcagacgaagcgcctgaatatacggaaggctatgaaggcttctaccacctgctgtcgattcaaggagacgtagaggaaacaaagctccactacattattagagactttgacaaagagaatttccaaaacagaaaagaaacaatgaagcgtgtcgttgaagtacttcaaaacgaatacggacaagacaggattctgctggatatgaacgaccaatactacaacatgagagagaaaattgaacctgtcatcgaaatcgtcaacattgccaagcaagcgatggaaaacctcggcatcgaaccgaagatttctcccatccgcggcggcaccgacggatcgcagctgtcctatatggggcttccgacgccaaacatctttacaggcggggaaaatttccacggcaaatttgaatacatctcagttgacaacatggtcaaagccgtaaatgttatcgttgagattgcaaagcagtttgaagcgcaagcctaatgccaaaaaaccagtccaaaaaaggactggcttttttgtgtgaaagtgaaacattttaaacgcgtcctccgtaaaacaagtattaacaaatgaggaggaaaaacaatgacaaaacatgcaatcgctgcaaagagtctcttgaaaaaatggatcatttccaggccgcttaacatgcaaaagaaatccagcccatttcaaaaaatcagaaaaatgttcaaacgcttcttcaaataaaacattcaaatcccctaaatacaatccgtattcacccgtaccgcccaaatgctccgtaatttgggttttttgtgttcaattccgcaaaatagggtataaaccaaacaagcaagaaaacagcacccaaaaacaggtaattcgaattacgtaaacttaggttaaaagttatataaaggaatttattttatcgtcgatagtaactatagaaccaatcatcaacgagagcaaacagcgtaattcaagactattttcaggtcatcaggtaatactgttttagagggacagtttcttgttatttattgatttagaattttttgaatactttttggcattttatccgtacaatagagagtaccaaaactttttttgggaggtatgtaatatgatcctatttattatcatcgcattatgcggctatcttcttttttctttcagcaaggacaatcgccgcaaaccgcaaaagacaagccctctgccagcagccgcacctcatcacaacaacctaatcgaccttgacgccatccgccaaaaacgccggatgcatctttcctaattctatatttcaaacgaaaaggctgctgaatcacgcagccttttaaaattgttttgatttagagcctgaaaccttttcgccacatatccgtaatttcatacaaggcaaacccaaaggagacttcagcaatgatcgagttatttatgaaacaaaaaatgttctcatttaaagatgcatttcacatttatgaccgggatgaacaagaaacattcaaggtggaggggcgttttttctcgttaggagactcattacaaatgacagactcatctgggaaaacgctcgtttccatagaacaaaaactaatgtctttattgccgcgctatgagatttcaattggcgggaaaacagtttgtgaggtaacgaagaaatgtaacgtttttcaaaccgaaatttgtgatttccgggcttaactgggaaatcgatggtgatttatggagggatgaattccagctgacggacggggaaaatgtccggatgtcagtgagcaaaaagtggctcagttggggtgattcctatcacttgcagattgcaaacgaggaagatgttctgatttgcactgccatcgctatcgtgcttgatatggttttatataacgatgaagatgaaggtattttctaaaaagcattgacaattgatccaaaagtaataatattaagataattgaaatctgaatatgaagttataccttatcaagagaggtggagggactggccctatgatacccggcaaccgctgtttcaaacagaatggtgctaaatccttaagaacattgtgttcttgcagatgaggcggagatttgatcgttcaagctcttccttacacaaaggaagagctttttacatgctcaatatttcagaaaagaggcgaataacatggctcaacaaacgaatgttgcaggacaaaaaacagaaaaacaacgcaaagcacctttccgcgccgatcatgtcggcagcttgcttcgttccgttccggtaaaggaatcccggcaaaaaaaagcggcaggtgagatgacagcggaacagcttcgtgatatcgaaaatcaagagatcacccgcatcgtggaaaaacaaaaagaaatcggtctcgatgtggtaacagacggggaattccggcgttcctggtggcattatgacttcctggaagggcttgacggtgtggaaccgttcattccggctgaggggattcagttccataacacaaaaacgaaagcgcgcagcatcaaagtgacgggaaaactcgattttacgagccacccagcgcttgctgattatcaatttttacatgagattgccggtaacgcgacgccaaaattgaccattcccagcccaaatatgctgttttttggcgaaaaggcggataaagggatttatgacgatcaagaggaatactttcatgatctggcccaagcgtacaaaaaagcaatcaaagccttctatgatgctggctgccgttatctccagctcgatgatacgtcatggtctctcttctttgaggaaaaaggcagagaggttgtccgggcgctcggcggcgatccagaaacattgccagccatatttgccaaaacaattaacgatgccgtcgcagaccggcctgacgatttaacgatcacaatgcacatttgccgcggcaacttccgctcaacctgggcggcatcaggagggtacgacgctgtagcggaaacgattttggacggcttaaaccttgacggccttttcttggaatacgatgatgaccgctccggaaactttgatccgctccgttttgtgaagcgcaaggatctgcaaattgtgctcggcttgatcacatcgaaatacggcgagcttgaaaatcctgaggatgtgaaacgccgtatcaatgaagccgcgcgttttgtcagcttggaccagctatgcctgagcccgcagtgcggtttcgcctctacagaagaaggcaaccttctgacagaggagcagcaatgggcaaagcttcgccatgtcatcgacattgccaacgatgtgtggagataatctatcattgacagaaatagaaaatgtgtgaataatagatactatcagaaaatttcataaaaaggttttccttatcaagagaggtggagggactggccctgcgatacccggcaaccgctgtttaacagaatggtgctaaatcctttagagcaatgattgctcttgaagataaggttgagattgtcacgcaagctcttccttatccaaaggaagagcttttttacatttgaatggaaagaaggaatggacaacatgtcacaacaaacaacacccgcagaacaaaaatcacttcaaagaaaaaaaccgccgtttcgcgcggatcaagtcggaagcctgttgagatctgagcccgttaaaaaagcgcggctgcaaaaagcggccggcgatattacggctgagcagcttcgccagatcgaaaacgatgaaattatccgcattgtggaaaaacagaaggaaaccggcctgaacgtcgtgacagacggtgaattccgcagagcatggtggcactttgatttcctggaaaacttagatggcgttgagccgtttactcctgagcaaggcattcaattccataacgtacagacaaaagcacgcggcattaaagtcacaggtgatatcgacttttcaactcacccaatgcttgaagattactcatttctccatagcattgccggtgacgcgacgccaaagatgacgattccaagcccgaatatgctgtttttccgcggaaaattggaaaaaggtgcatacaaaaacgactatcaccttttccagcatgatgtatccaaagcatataaaaaagcgattcaagcgttttatgacagaggctgccgctacctccagcttgatgatacagcgtgggccgttttcttatctgaaaaaggcttaaaacaaatcgaagcgttcggaacaacgcctgacgagcttcgccagctgtttgcgaaatcgattaacgacgcgattgcagaccgcccggatgacttgacggtaaccatgcatatttgccgcggcaacttccagtccacttggacagcggaaggcggctatgacgcagcagccgaaaccatttttgacggcttgaatcttgacggacttttcttagagtatgatgattcacgctcaggcggatttgagccgctccgttacgtaaaacggtctgatcttcagcttgttcttggcttagtgacatctaaattcggtgagcttgaaaatccggatgacgtgaaacgccgtatcgaagaagcgtcccgttatgtaagcttagaccagctttgcctcagccctcaatgcggatttgcttcaactgaggaaggcaacaagctgactgaagaacagcaatgggcgaagctccgccatgtggttgagatcgctaatgatgtttggaaataagaaaagaaaaaacacacttgattccctagcggagcaagtgtgttttttatgtcattgtgcggtgtagcccccatcaaggacgacagcctgcccagtgacgcccttcgccttctcgcttgccaaaaacacggcataatccgcaatttccttgacggaaagcagtcgcttttgcggcacaagcggaaaaatgacttgttcaagtacagagtcgtaagggacatttctagttttcgatagatcgctaagctgattgcgtacaagctgggtatcgacataacccggacagagcgcattgactgttatgccgtggggcgcgccttccagcgcccctacttttgtgagtccaatgacgccgtgcttggcgctattataagcggatttccctgcaaagccgactaatccattaacagacgcgatattaatgattctgccaaactgctgttttttcatgatcggaaaaacatgcttcattgcaataaagggggccgtcagcatgaccttgatcagctgttcaaaggtgtctgtcggaaactcttcaatcggagcgacgtgctgaataccggcattgttcaccagaatatccaagcggccgtattgtttttggatgacgttcaccgtatcagcaacttgcgcttcctttgtcacatcatacggaatggccgccgcgtcaaagccttcttctgcaagcttggaggctgctttttcacatgcttccggacggaggtctgaaacgatgacgctggcaccttcccgggcgaattctcttgcgatttcgaatccgattccgccggcagcccctgtcaccaaagcgacttgttttctcatgtcaaacaccttcccattaagaattgagtacagactggcttacagcgaaatcagcttctgttttttcataaacctcttcaattgtgacaccatcctgaagctccgtcagtgtcatgcggccgttcacaaaatcaaatacagccaaatccgtaatcagcctgtgtacgactttctggcctgtcagcggatgagagcatgtttttttcacctttgattcaccatgcttattgacgtgctccatgatgacaacgattcgtttcgccccgttgacgagatccatggcgccgcccatcccttttaccattttgccggggatcatccaattggccaaatcaccctgctccgaaacctccattccgccaagaatagccaaatcgatatgcccgcctcttatcatcgcgaatgactcagcgctgtcaaaataagaggcgcccgtcacttcagtgatcgtttcctttcccgcattgatcaaatccgcgtcttccgttccttccagaggataggggccaattccgagcaagccgttttccgactgaagcatgacgtgaacgccatcgggtatctcatttgcgacaagcgtcggcattccaatcccgagattcacattcatgccgtccttgatttcttgtacagcccgtttgaccattcgttttctcgcttccttcacttggcctcaccctttcccgatgcttgctgaactgttcgtttttcaatccgtttttcttggctcgcgccaagcacgacatgctgtacgtaaattcccggcgtatggatatgatctggatcgagctctcctgcttccacgatttcttccgcctcggcaatcgtgatcttgcctgccatggcggcaatgggattgaaatttctcgccgttttcctaaaaaccaaattgcccatggtgtccgctttccacgctttgacgatcgccacatcgccggtaatgcctcgctccagcacataagtccggccgccgaatgttttatgttcttttccctcggctatggaggtgccgacgcctgtcgccgtataaaatcccggtatgcctgcaccgcctgcacgaattctctcagcgagcgttccttggggaacaagctcgacctcaagctctccgcttaaaaactgccgctcaaaaattttattttcaccgacataggaagcgatcattttcttgatttgcttgttagccagaagcaaaccaagcccccagtcatcgactccgcagttattgctgacaacggttaaatcctttactccctgatctcttatagacaaaatgagctgttcagggatgccgcacagcccaaaccctcccgcgatcagcgtatccccatcatgaatcagtttcgcagcttccttgcttgatgacagcactttttccatattgatgcccctttcgttttcttctacactagaccagtcaggctgtaaatcgcgatcacagcaaatacggcagccgttttaatgagcgtgatcgcaaaaatatcgcgataggattgccggtgggtcaaacccgtcacggccagaagcgtaataacggcgccattatgcggcagtgtatccatcccgcctgatgccattgaaatgacccgatgcatcacctctggcggaatattgtaagcctgaatcgcctgtaagtattgttctgacatcgcgcttaacgcaatgcccattcctcctgaagccgagccggtgattcccgccagcgcagttgtcgtaacggcgccatttacaagcggatcggtaaaagtatgtgaaattccgctgctcagcttatgaaaccccggcagtgcggcgataatgccgccgaacccgtactcggcacccgtattcatagatgccagcaaggcgccgccaattccttcattcagcccttccttcaattgggcaaacacacttctccaatcaaataaaatcgttgtgatgatgccaatcactaaagcaatctccaccgaccaaatagcagctgctgaagaaatatcaagcctgccgaactcctttaatcctatggaagaaaaatcaaatccattcggataccactttggcaggtaaatggtaaaatatttattcactgcaccgacgagaataagcgggacaaaggcaagcgcgtgccgaatcgggcttttgtccggttcagccgcggactcaatcgattcaggagcaggagcattctgcgaatcaaaaccgccatagccttcgccagatgcctgcgcttttttccgccttgattccaaatagagcatcccagctgccagcacaatcactgcgcccatcaagcccagccaaggggcggcataaatgtctgttttgaaaaacgacgtcggaatgacattttggatttgcggcgttcccggaagtgcgtccatcgtaaacgtaaaagcccctaaagcaatcgttcccgggatgaggcgttttggtatgtttgcttcttggaacatgtttttcgcaaaaggatatacggcaaatacgacaacaaacaggctgacaccgctgtacgtcaagacagcacccatcagcacaatggcaagtatcgctctttttgccccgacaagccggacaattgttttcgcgattgatgccgcaagcccggccatttcaacgacctttccaaaaatggcaccgagcaaaaacactgggaaatacagcttaataaaacccgccatcttctccataaaaattgatgaaaaaaaaggaagcacatggcttggatctgtcaggagcaccgcgaataacgcgcaaatcggcgcaaacaatatgacagaaaatccccgatacgccgtaaacatcagcaaacctaacgccaatagaatgatgatcagttccacacacacatcccccgtttccgcgaactagaaagcgtttacaaaaacctgtccgcatcggctgtttccgtcccctttccatatgtacgagaagcgtgggccaactattccgattaaaaaaggaaagctccttttttcggagctttcctctgccattcatttcattcctattaggatatcaacatcaaccgtaatatcggctgttttcatctctttcaggaggctgactcgatctttcggcgccgaccaggcaagcggcgtcatcttgagaagccagtggatcgcctgctggtcaagcgttttaacatagcgcagcctgacaggacggctgtgtgcagcatttgctgcaaaacgctcaacagctgccgcattggaatacgtgcgccttggtgaatcagtatataaaaattgccttaattctattaaatagtcgcttcgcggcactacttttacgagcatgccatcattcttcagcagtctatgaaactctgcataattggacggcgaaaaaatagacagaacaacatcaaattggcgatcatgaaaaggagcacgcgccacatcggcaaccgcccacatctgatctttgaatgccttagaagcttttaagatcccatccttcgaaagatctatgccggttcctatcgctgctttccctgcataatcaaacccgcaaagcgcattcaaatgagaaccctcaccgcaaccgctgtccaggatggtgaatgcctcatgaccagatgtgggatgactgatgagttctgcaatcgcatcatggagcgggtcaaaaaaaccacattctccaatcagcctgctcctcgcttcaaaaagctcggcaccgtaactggttttgaccggcttcgtcagaaagttcacgtagccgtgccgagatagatcaaatgtatgtcctcgttctgtacaaatcaagcttttccctgatgccgcatccatagaagaatcgcagagcgggcatcgaaacatgctgaaatcaactgttcgcttcatgataaaaaacaccccattcattcatttttagataaatgaaaaaggcatagacaaataaacctaggcctatctcaaaaattggccaggtctggcagtttgtctacacctgtcattatctataacgaatgaattggataatcatgaaaaaactccctttctgctgtatgggtttccccatttccattatacaacaaatctccaggatctggaaccttatagtgaagaaaaatcagtactgacatgctggtatcccgccaacatcatatcagcatagcaatccagcatgtttttcctttattttctcattttagaatataaattttattattgtgaaaatagttaaaaaggttgattttcaaaaagtgaaaggataaaatactgctatcatcttagaaaaagacattcttgtatatgatcagtaatatggtctgattgtttctacctagtaaccgtaaaaaactagactacaagaaagtttgaataaatttgaacgagttgaaaaggacaagttcttttctgtttgctcttatttttcacactttctgcacttccagaatttgtgaagaataagagctttttttgtttccataataaccctcataggagttgctatcatgtactttttactaaaccttgtcggtctcattgtgattatggcagttgtattcctatgttctccgcagaaaaagaaaatcaagtggcgcccgatcatgacgttaattgttctggaattgctgattacttggtttatgctgggaacaaaagtcggaagctgggccatcggtaaaatcggtgatttcttcacttggctgattgcttgcgctagtgacggtatcgcgtttgcctttccgtcagtaatggcgaatgaaacagtagactttttctttagtgcgcttcttccaattatctttatcgtcacattctttgatattttaacgtatttcggcattttgccttggctgattgataaaatcggatgggtgatttcaaaggcttcccgcttgccgaaattagaaagctttttctctattcaaatgatgttcctgggaaataccgaagcacttgcggttatccgccagcagctaacggttttaagcaacaaccgcctgctcacattcggcttaatgagcatgagcagcatcagcggctccattatcggatcttatctttcaatggtgcctgcgacatacgtgtttacagccattcctttgaactgcttaaacgcgctgattatcgcaaacctgctgaatcctgttcacgtgccggaggatgaagatatcatctatacaccgcctaaagaagagaagaaagactttttctctacgatttctaacagtatgcttgtcggcatgaacatggttatcgttattttggcaatggtgatcggatatgtcgcattaacgtcagcagttaatggcattcttggcgttttcgtacatggcctgaccatccagacaatttttgcttatctgttcagtccgttcgcattcctgcttggactgccagtgcacgatgcgatgtatgttgctcagctgatgggcatgaaattagcaacgaacgagtttgttgcgatgcttgacttgaaaaacaatctcaaatcccttccgcctcacaccgttgcggtggcgacgacattcctgacgtcctttgcaaacttcagtactgtcggcatgatttacggcacgtacaattcgatccttgacggagaaaagtcaacggtcatcgggagaaacgtgtggaaactgctcgtcagcggaattgcggtatctttattaagtgctgcgattgtcggcctgtttgtgtggtagaaacattgagccatatcccttttcggatatggctcttttcattattgataaatagaggctggcacctgcacatcccggattcccgctgcataaggccccaagtcatactggccgaagacgatggcgatcccgtttgccgtaaagtaaaacattgtgtctctgtttagggttatatcctctttctttacatcagggaaaaacagctcatcgtgttttttgatatagctatataggtaatctctcgttttgctgacttttgttttggtgttcagaatctgatccagcgtcacccgcttttgtgctttcaagtcatagttgaaggactggacagacgttaaaccgtgggcgccccctgaatagatataattgagtgtttgaatgctgagcttgcctgccgcattgtatttgacgctaaaggatgtttgatattccgttttaaagccctgctgttcgcctgcttttttgtttttcaggtattcctgatacgattgttcaatgtaggctttcagctcttgattgattttcttttcaaacgcggcattcccgatgtgatgcacttgtggatacgttaactccttgatctttttgtacgtatgagtgctgacagtcggtgttttcgtttgaactgcgtttagagatggggccgcatatgcaactacggaaaaaagcaagactgcaatccccgcggctttcatcattttattccatttcatacaatctcctcctttgatgtcgttgtttatcattcccttatttaagcaatacacacttttatagactgattaaatcgaaagaagtttctaggtctaacagcatgatttttccaataaaaaaagagacacaggatgtctctttttttactgtttgcgcccaaaaatcgcttcatgaacggcctgtgccaaatctgtatttccgaacatctctaataccgcaatgacagtctggtccggaatgtgctctgcttcgtgttttggcacgaccagatcgtccatggtttttttcaagctttcattcagcttttgctgcggatacgctttggtgtacatctccaccggatcaagatcatggttcacgcaccattgggcaaacaccaaaatcatcatattttcatcgcgttcgtaagcttcagcgagctgtttttcgttcatttgtcatgctccttatgaaaagtatcttccttaaagatacaggagccgatcaaattcgtctatcccaatggcgatgagcagaaaccgcatcgataaatgccttgctgaaagcggtgtagtcaggttcatctttagccgttacgatgcctggcccctctgttgtcccgacagaggattgaagaaggtcaattccttcatttgccgcaccgatcgccttgtagtgattgtaagcttctctgataaactccatcgcttgtttgttgtcttttaactccggccctcctgcggcatagacggcatcatacagaacagaatcaaccgtcaggaacgtgccgctggcctcaagctgctgtccgctgccgcttgtcatataccccagattttgactgatgatatctactgtgattccttcttgctttaaggcttccagcactgtttgcagctctttttcatgaaatccgtttccggtgagtacagcgacttttcttgttgacgcggttttcactgtacgggcttggcttaacgcaggcgaagtaagaatttctttagatgctttacgcttcgcgggcgccgccacgcctactcctttggcgatttcttctgctaaatctgcatcgacattgctgaagacatcaacaacctgccgctgtacgtctttgcttttgaccttcccgacctcgaagcagaaagcagaaatgatgtgctgtttctccacaggagacatgctgttccagaaaagcttcgcctgtgagtaataatcgttgaagctgtcgcttcgctggcggatttttttgccctcgactttttcctgatagtggacgtagccgccttcttcagctgtcgcaggcgacggatcattgttttgcagtgagtttttatgataagcgacaggccccttattgatcgtcatccgatgataaccgtcatattgattgttatggaatggacataccggccggttaatcggaagctcatggaagttcggaccgccaagacgaatcagctgtgtatccgtataagagaaaagtcgcccctgcaatagagggtcatttgtaaaatcgatgcccggcacgacatttcccgggtggaatgcgacttgttctgtttccgcaaacacattatccgggttgcggttcagcgtcattttcccaatgatcttcaccggcacaagctcttccggccacagcttagtcggatcaagaatatcaaaatcaaacttgaattcatcttcctcatcaatcatctgcacgccgagctcgtattcaaccttgccgccgttttcaattgtttcccacaggtcacggcgatggaaatccggatctttcccggcaattttctgcgcttcatcccatacgagagaatgcacgccgagcaccggcttccagtgaaatttcacgaaacgtgcctttccttgttcattgacaaaacggaacgtgtgaacgccgaagccttccatcattctgtagctgcgcgggatgcctctgtctgacatcgtccacatcaccatgtgagccgactcagggttattggcgacaaaatcccaaaacgtatcgtgagcagtcgctgcctgaggcatttcattgtgaggttcaggcttaaacgcatgaaccaaatccggaaatttgattgcgtcttgaatgaaaaacaccggaatgttatttcccacaaggtcatagtttccttcttcagtataaaattttgtcgcaaagcctctggcatcccgcaccgtgtctgcggagcctttagaacccgcaaccgtagagaaacggacaaataccggtgtcttcaccgaagggtcctgaagaaatttggcccgtgtatattccgtcattggttcgtaaacctgaaaaaagccatgcacgccatacccgcgtgcatgcacaacgcgctccggaatcctctcatggtcaaagtgcgtcattttctcccgaaagtgaaaatcctccatcagcgtcgggccgcgaaccccggcttttaacgaatgctcatcctctgatactcgcaagccttgatttgtcgtcattttcttcccgctgttatcggtcctgtactgctcaagctgctcgtcctttgagtgttcatttacacgtttgttttggtcatcactcatgtctgctcccccttttaaaacgaaacattctacagcacatttacccgtggcgttcttcatataaactgctaatccgctcattaggatttttggtctacatataaatatgcggtcatacacatttgaaataagccttcttcacagaaagaaaggatggaagcgcttaccaaaaaagctgttgaataggggaggtcatatcatgcttgccatactcggttttgtgatgatgattgtctttatgtaccttattatgtctaaccggctttccgctcttattgctttgattgtcgttcctattgtgtttgccctgatcagcggatttggcaaagatctcggcgagatgatgattcagggcgttacagacctcgcccctaccggtatcatgctgttattcgccatcctgtatttcggcattatgattgactcaggcctgtttgatcctctcattgccaaaatcttatcgtttgtcaaaggagatccgttaaaaatcgccgtaggcacagcggttctgaccatgaccatttcgctggacggagatgggacaacaacctatatgattaccattgcagcgatgctgcctctctacaaacggctcggcatgaaccgtttggtgttagcgggaatagcgatgctcggttcgggggttatgaatattatcccgtggggcgggccgactgcgagggttttggcttccttaaaattggacacgtcagaggttttcacgccgctgattcccgctatgatcgccggcattctctgggtgatcgccgttgcttatatcctcggaaagaaagagcggaagcggctcggcgtcatttcgattgatcacgcaccgtcttccgatccggaggccgcaccgctcaagcgtcccgctcttcaatggtttaacctgctgctgactgtcgctctgatggccgcactgatcaccagcctgctgccgctccctgttctttttatgactgcgttcgccgttgccttgatggttaactatccaaatgtcaaagagcagcagaaacgaatctcggcgcatgcgggtaatgcgttaaacgttgtctcaatggtgtttgctgcgggcatattcacaggcattctctccggcacaaaaatggtcgatgccatggcgcattctctcgtttcactcatccctgatgccatgggcccgcacctgccgttgatcactgcgatcgtcagcatgcccttcacctttttcatgtcgaatgacgccttttacttcggtgtccttcccatcatcgccgaagccgcttccgcttacggaatagacgccgctgaaatcggaagggcctccttgctggggcagcctgtgcatctgctcagcccgcttgtgccttccacctatctattggtaggaatggcaggcgtcagctttggcgaccatcaaaaattcactattaaatgggccgtaggaacaacgattgtgatgacgattgccgcacttttgattgggattatttctttctaaatgtatgagcttgatcgtagcattgagtgagtacgtgatttacagaggggagaagatcaaataggatattatgagtgaatagaagattcatgccaacaacttctcattacaatcataagagcctgctatattgcagcaggctctttcacatttggcattatttttttgtatagcgcacccagtcataatgagcgtatagcggatttacaccattgtaggaaccaagccattcatcgacacccgtgccattccacaagttcatcatgatctttccaggtgttgtcggaatttggtttgttgcagtatgttttaattgcccgtcgacataccatttaatagagtttggctgccaatcgaatgcataagtatgataggcattggctgcatcaaacccgagatcaacaatcttctcatggtttcctgcaccatttgtataatagttaaattgaaccttcgttgtgtcttttcctaaaaattcgatatcaatctcatcccaaggagttccatctgttggacctgtgtaagtgaagaacgatgaaacgatccctgtgtttttagctggtttcattctgacttcataaagtccatagccatatgtttgaacagaacggttttccccgcagtcaaacttgttataagctgggcttgttagcgctaaacgcatttcacccaatgacgtcattgatacgttattagcccgccacgtgcagttgaacatatttccattcgaataaccatctgctttttgccaaaaaccggagttatagccgttaaaagggtcaaaaaacgatccacctgtttgagctgaggcagtagaagtgactgcaaacaaactcataaacaatccagtgacaagaagcagcaacactcgtttcagataaggcatattggcattcccctttcattgaaagcgttttctatgttgatcttacatgattcttttaaaagggaacatcggtcaaaataatgataatatcgaatcttactgacttgaatcctgtaactatcatcatcttccctctgaaaaaaataaaaacctaaattaccatcagcacagacagagatgatccgcactcattgtaatttaggttttgcctgctttatcagtaacaatcctaccattttcatatgtgaatgtaagaaaaaatgaatacaaggaaacaaaaatgtcagcgctctcattatgcttgtttaactaccctttctatgtgaatggttaaatacagcagctcgtcacttgtgagcttgtgctcatactcccgctcaatgtaggtttggattttcttcgtgcattcatacgcgcgatgatacttttctttcactgtatccagcaaaaaatcgtcctggctttccatgtgagtgccgttaaaaagacgctgcgcgaaaaactttaagtgggtgacgaaccgataatagtgaagcgattcttcgttgaattcaatcttaaaatggtattttacaatactcaaaatctcttgcatgacttttgtaatgttgataatattgggcatctcttcattcagctcggcatttacaatatgcagagcaataaagcccgcttcatcctctggaagagacacacctgtcttgtttttcaccatgaccaacgcttctttgccgatcgtaaattcgtctttatacagccgttttgtttcccacagcaaggcgtttttgatatcaagccctttctggttgcgctggatggcaaagttaatatggtcggtcagcgacacatagatgctgtcgttgagctttttgccgagctgtaattttgcgtagctgataatctcttcggatacttccatacactcgatcggtatatcatacaaaagggttttgaacttttctgatacatccttgttatcgagcgtgaacactttctcaatgcgggcttcatcgacatcatcgccggactttttctgaaacgcgagccccctgcccatgacgaccaattctttcccttgttcattgaccacgctgatcacattattgttgatcaccttcgcaattttcatgacatgtccctccaatcaactaagaacagactatatcttgattgtacattctttttgtactaggtcaatatcatcagggaaagacggaagctggtcagtacaattcactccgtacctgctgcccgggctgtttttgaagcagcgcctccagatggcgttcaaatgatgccttgtcagctttctgctttttgacaatgctgttcatgattttgacgctttcggcgctgtattgtgtatattgttttttcagctgatccagctgctgtcttgtcttcttcgcgtttttcggtgtgacttggccgatgagtttgatcatactgtctgcggtctcaaaaaaaacggctctattttctgtcagctgctgaatttcgatccggctcatgtcttgattacgcgttttttgtagcaaggcgaccgcctcgctgttttgttttttgagcgatttgttctcaagcttaatcgattcgagattctccttcgcaatgtctgcttcttcttcagtcatgttgcttcgcacgaagtattctggattaccgattccataatcaaatgcttcgctcacttgtatcatggaactgaacacaatggccagctgcctgtcgcttgcgagggcttggaaatcctgctttttcttactgctcatcggtttggctgcggtttgttttactgtcttttgatcacagtctgcgaacatctgagcctcaccttcactttcgcatgcgctcatcacaagaactgtgaccagcaggcttatacacaagcctattcgcctcatgctctgtctcctctctgctgaatcccttctggaaaataccataaaatatagttaaatggtaccagattcacctaaccccagcaataaatcaaaagtatgatttgaagcgcaaaaacataaatattttgtaaaaattgacgtgcattccattcttttcaggcccatttttcgtacaatagaagtatcgttaccggagagggggctctgatgatgaaacgttttacgaaacaagaaaacagctgggtattatatgactgggcaaattctgcttactcaattgtcgtgaccaccgcggtatttccgttattttataaatcagcagctgcggaaagcggtgtcagcgccgctcaatcgactgcctatctgggctataccattgcgatttcaacgtttattcttgcgatgctcggccctattttaggcacaatcgccgactatgaagggtgcaagaaaaagttcttcggtttctttgtgtcagtcggtgtcgccagcaccgcgatgctcgcctttatccctagtgaacattggctgctattgttgctgttttatacgatatcggctatcggtttttccggcgccaatgtgttttatgatgcctttctcgttgacgtcacgcctgagaagcggatgaatctcgtctcagcacggggttttggcttaggatacattggaagcacgattccatttatcatcagtattgctgtcatcctgctcgcacaagcagagacgattccagtgtctgtatcggccgcaagccagctgtccttcttcataacggctgcctggtgggggctgttcaccatcccaatgattaaacatgtccatcaacgctattacatcaaaaaagaacctcatattgtcatcaacagctttaagcggctcggccaaacgatgaaacggatcaggcaataccgggcacttttcctcttcttgctcgcttatttcttttatatcgacggagtcggcacgattattacgatgtcgacatcctatggatcagatttagggatcggctcctcaagccttctgatcatcctatttgtcacccaggtagtcgccgcgccgttttcgattgtatacggaaaactggcagaacgcttcacggggaagaccatgctgtacgtcgggatcgtcatttatatgatcgtctgcgtgtatgcctattttatggagacaacgcttgatttctggatactggctatgcttgtcgccacctcgcaaggcggtattcaagccctaagccgttcctatttcgccaagcttgtgccaaagcgccacgccaatgaattcttcggtttttacaacatttttggaaaattcgcctcaattatggggccgctgctcattgccgtgaccgcccagctgaccgggaaatcctcaactgcggtgttcagtctgatcattttgtttgtaattggtattgtgattctggcctttgttccggaggagaccagcgccgatgtcagccagcagcaaaatgacctgcccctttaactgggagcaggtcattcatcatttattcgctttattcaccttcagctttttccctttgacggttgtgttcttcatcactttgagaacatgagggcctttaccatttaagatctcaacgtatgaggcgttatccatgatcgtgatgatgccgatgtcgtcagctgacacaccgtcaattttggcaatcgttcctacaaaatcaacggctctgattttctttttctttccgccgttaaaatacagcttcataatgtctttattcagctcttcgcttttgtcctttttgctttccggacggtcattcagtttagctagaaattctggtttcttccttgccacttcctcttgagaaggtgcttctattttttgaatttcaaatccgatatattcttcaatgtcggctaaaaaccgtttttcgaaggccgtgacaaacgaaatggcctttcctttgttccctgcgcgtcccgttcggcccgtgcggtggacatagctttccttttcaaccggcagatcatagttgataacaagggagatattttcaatatcaatcccgcgcgcggcgacatccgtcgccactaagtaacggtactcgccacgtttaaattcattcatgacgtcgaatcggtcttcctgaatcattccgccgtgaattttatcgcatggatatcctaagtcatccaattcatcggtcagctgattgacgtgctccttcgttcggcagaaaatgatgcagctgtcgggattctccgtcatcagcacatctttcagcaatgaaaatttatgctcttctcttacttgaatcaccgcatgttcaatatttcttgtggtaagcccggccgctttgatttcgatatgctcggggttttgcatatattgacggctcagcttctcgatatcctgcggaagcgtcgccgaaaacagcatcgtcgtacgctcagtcggcagatgcttgataatcgcctccacctgctcaatgaagcccatattcagcatctcatccgcttcatcaatgaccaaataagagagacgatccaacggcagcgtgcctttttcgatatgatccagaacacgtcccggcgtgccgacaacaatgtggcttttttgcttaagctcagctttttgtttatcaaaggaggattttccaaatacggctgtcgctttgatccgtttaaatcgtccgatgttcgtgatatcttcctttacttgcaccgcaagctcacgggtcggtgttaaaataagcgcctgcggcttgttttcatcccaattcgccagctcacagagaggaatcccgaacgaagccgttttcccgcttcctgtctgtgatttgacgacaagatcctttcgttcaagggcagcggggatcacactctgctgcaccttggtcggttctgtatatcccagtccttccaatgctcgtaaaatgtcatgactgatttgatagtttttaaaatgactcatgtataaactcctgtctcttgcagatgttctcattatactctaattgaccaaggcatatgtgttttgtcgaaaaatgatgtattaaaagccagcgattccctggcgttttagctcctgaacagccaatcgcgccagtgcgtcggcccccgcgcgattcgggtgcagcgtatctccatccatataaagcccgagtgttctttccggaccgatcgatgtaaagtatgccgagctgaggacatttaagtcaatgagatatgttttttcctcttcggccaaagctaaaatagaggccctgtaccatctgtttacagacgaatggatgccttcagaagtaaaatcggttgcccggccctgaggcgttgataggatgacgtccgctcctttcgcttttacctgacgaatcatatcacgcatcatctctttaaactccgcttcagattcattatgcttcggatttgtgtcattaatgccaagctgcaatataaaataatctcccggtttaatatacttcaggatcgcctcaagctgtccatcatttctgaaccctctcgcgatctgcccgccggacgccatgtttctcacttgaaaggtgtgtttatcgatatagtgaggcagcatctgcccccagcccgcctgcttgctgctgttgagcggataataattgcacaccgtcgagtcgccgccgacataaatggttcggttcgtcaccggctgatcagacaatttctttattttcaaggcgctaagcgtaaaagcggtgccggctttcccctctgtcaccagtagattcagctgcccgtcggtgacaggaatttggaacgtatcctccgcgccatcccctgtcatattgatgacctgaaacacgccctccgccgccacactggcccttgccgtattgccaagcgtcgccttcacctcataaaggccgttcgggagatccacttgaaacgtgttattacttttcgtcccatacgctaaaaactgaaccgcatcactcttcactccagtcccagatgctgccacatccttcatattctctggtgtttgaaagccgtagccctttgaccggtcataccgattagacgccctgacaccaatataaccaggctcaaccgaaccgtttccaaagtcaaactgatacaccttctgctccgctgccttcacactctcattcccgtcaaaacccaacatcaacatcatcacaaaaaccgttgccatccattttttcatcaagactccccctctatgaaaacgcatacattaatgcatactcggtgattgtttctttatgatgactgaatgaagaaaaaaatggcgttgaggaataaaaatgaggggagagtctcaagaaggggaaaatcagtgtgacttcttgtcacacttgatcacatcccaacctccgcaatagaaactcatctgatcttcttgatcatacacataataacggagtctttcccattgatcgtcagtcggttcaatctccaactcaaccgcatcaatggattcaaggtcatccagccttgatgcactaatgtcttcaaaccgcaaatgaatgtcacaggtttgagctgatcgttttcattcaaacacaggaatatgaatataacgatcatcttctttcatatagaaagaaaactcgtttaatgtaaatggacctgtatcctcatcagaaagatgctttttcaatttctcgtattgtgtgatattcaaatgaattcctcctatttttagttacctccaaccatatagatctccgcagcatcgtattcaaaccatatgatccgttcgcctgagtccgttaggcattggagcttcccttctgaaaaatagcttttatccggttggggatcagtgatcagaaaaacatcatcattgatggaagctaacagaaagagaaaatctgcaatatcccggtctgcttcctgtaatatggattggaaatggaattcccttttgtccagcttcgtcaccttgtaagcatgaccttcaaaatactcggacaggtcttctataaatgaaccagtcgttattacctgtatcatgattcgatcgtaggcaagccctgcccaaaaacgataaaacgactctgcatctttaagttcgcatgacataacggtttggtcaggcttaagctcgatcatgtccaaattgccaatactgcttatagaggttatttccataaaatcttccccttatcagttggatagcgcaacgcaaatctcttgtctgacttgttcatacaagagaatatgatgatacagatccttatcgttttcgatcatatccggaagtatgtcaggatacagctcaaaaaagcttttctccaacgaacgccgctgttgccggggcatccttttattcgccagcacataatccaaactgccatcaacaagcataaaaaactcatagatttccgcttcaaagccgtacaattcactaggatacggcgtttcttcaagctctcgctgtctttttttcagtttttcaaacacgccgactctctcctccgacacatgttaaataacaaactaatctatcttgaaacaggataggcggatatttatctatcgcctccaacaggtcttcaccaaacacagtgattgtcaatttccacgggtctcccaaaagtccccaagagaagtcctgatgaaaaaagaaataatagtctccatttggaaatacgggaacaggccattcgccaaattcatcctgaggcattgcctgatgagggctaaacatatatccgtcatgctgccaatctagtgcgtacattacttcgttctttccagtacctaattgaaatgcttttaaaatagaagcctctaaatcactcagcactccactcacatcattatgaccagctttactgctcatcgcgcttgagatatcaaacactcgatatggctcaggcggaatgatgtgatgccatctgcttccgggtttccattttatgagcttgttcacttctgaccagatgcggtcttgttttgtctgacttaaagcgcgccaattcatcatgatctcatccctacacctattggatatcctgtttgtaaacaccagaagaggccactgcataaacagcgttacttgtcagtttcagctgttgaacgtctagggcttcaccgttcgagtcacagcatgttatctcttccatctcttgactcacatcggcagaaatcaaataaagagacgactcaagctcttcactgtaacaattgaacgtcccaaccaaaaaaccttcttcagatatcgcaagctgataaaatgcttctgagttcggctctttatccgacagaatccatacccgtctcacgaccgtgtcgtcaaacgcggcaatgactgcatctccgtaatacagcatataaatcaagccgtttttttctgcaagtccataacaatcatctacagccggcgcatccatttcttcgagctttctatcaaagtgtatttccttctgctgaccatccaaagtaaaacaccaaacactatgcccatcaggattttcatcatcataaatgccttcatcatttaaaccgacccaaaggttttgtttctcatccaaaagacagcaggaaacccctgaaggcaagtgaaaagcacttttcactcttccctcttctgaaaaaacctttaccttcggctcatacgattcgtaataaacgaagacatagccatctgcacattgttgaaagagcagaatatcactgtatgaaatctgctctttggctttaaaaacccgaatatcaccggaaggatcatagattgaaatggtcacatcatctttcacaccttttccaatgtagacacgccccagtggatcagcatggaaaaaacaatcttgggtgtccgtgttgatgactttattcatttttaattttttcatttgttatgctcctaggttagaaatgaagtgataattaagcatttattagctattagtaacggacagcctagtttcattaatcgttttgatataaagctactttccaattcagtcttaaagcatttagtatttaattggtatgcataaaacgattgatcatcaaagcgaactgtttcagcttcaatagcaatcagcattctgttcatgtcaataagaaagttagcatttgattgatactccggaattatataatttgatagattctcgattccttctggatgataactcatctcaaatacttgccaactgtattcttccggatctattttttccaatctcatgtcgccaacatctgcactataataagcggatgccacattttgaaatgatattttatgcgtatattcaccttcatcttcaaaaaccttaatatcaagtgagagttcttttttaaacacattaaaatctaaatgaagaacactgcacccctcatctatataatcaacccattcattaatcgtttgatacattgtcatcccctgcttctttttaatcaatagcgcctttccaccaagcagaaagcaaattactccgtatattgtttgatccaatcatttaaatcatctgttgaatgcaaataagtttcaggagaatctttcaaatcaattccgcttaaaaggattaacatatcccagactctaccgttttttactttagggtcatccgcataaatataagggcccgcccaatctgacacttcttctcttgttgtttgtccatttaagacacttttgattttatttatgcattctagtagttttggctcgatcaaattgatcaccacgcactcaatattcgtttggtataccgacaattctatttattttattaaagcctgctgagcaatcagatgatcaacagacaattcggtaaaagatcctctaccgaatgaattctattattcgctttgaagatccaaacaaagtatttaataaatgttattctcattaacaataattgcatttttatattcttctgctgatgttttcataaaagaaatttttttatgattaaataaagtattagtttttaaatttgcagagtatatataatcattactatcgctttttaataccaactaagttttcaatatattatatgctctattgttttatttttttcaagccaatcatagtcattaagagttgatatttcatcaaaatagtacattcacttttccttttactaattgagaaagctttttttcgcaccaagaatttgaaataactgtattattgatttaacatgttagcttcattggaataggattacaatatttttctggaacgtttatgttattttaagaatcaaaaaaaggccgcataggcctttttacattttccattattgcatttgttcaatatccgtaccctcagctgtcacattcgccttcccctgcctcctgacaagcgtcaaggccatgcccgcaaagatcattacgatgccaagcgtttgatagaggtcagggcggaaacctgtgaagacggtatcgagcacgattgcgacagcggggtcgagaaatacaatgattgaaataaatttcgttgataaaaatcgtaaactgtcaaaaaacaacaaatatacaatacccgtatggatgatgccggtagataccaccataatccagtttccctgagataggtcagcaaaagcgccaaagtgaataaacggaatcaggatgataacccctaaacccgtctgcaagaaggtggtcgtgtaaggactgagattgtgaatgccttttcccaataaagtggtgaacgcataaaacagtgcggcgagaactgcccatatgatccctgatcccatcagctgtgtcaatgaagtgctgccgttaatcccggaaatcagcgcagttcccagaaagcagatgataatggagctgacggagatcacatttaatttctctctgtagaggaagctacccagaagaagaacaagcaccggcgctagatgataaacggagatggcaattgtaacggacgtttcttcaaaagacttaaataagaacacccagttgaatacaagaaagaaaccgcacaccaatgtttgcagcacgtctctcttgctccatttttcagttttatactggccggacgccagccagcaaaggcctaaaaacagcgtcgcgcaaaggcagcggacaaagaccaattcaaatgacggcagattagtatgctctgagaaaaagccgatggagccgaaaatcaccatagagatgaccattttgattacggctgttgttgatttttgttttggtgtgattgagagatcttgctgcatcaagcgtattctacctccaattatgtatagggaaaagcaccccaactgcaaggtgcttttccttttttatagtttcttgccggccgtccagccgccgtctatgacaaagtttgaacctgtaataaagtgcgcctcatcagaagccaaatacttcatacaggaaacgatatcactcggctgcccccacgtatgaagggcatggttatctttgatcagctgaaccatttcatcgtcttgaaaatactcttccgttaattctgtttggatcacgcccggcgaaatgctattcaccctgatcccctttgatccgaactccatagcgagctgcttcgtcagtccgatgatcgcatgcttggaagacacataggcagcccgcgcaggctctgccatcagcccggacacagaggcgatgttgattatacaccctcgtttccccagctttgaccacagccttgccgcgtcccgagaaagaataaaggctgccgtgagattaatgtctatgacctttttgaatgattctgctgataattcaagaacaggggtaatttcccttatccctgctgcattgatcaaaatatccgggatcagccggcttttttcaagttttagcatcaaagattccgcctgccggacatcagacaagtctgctttttccatgtgaaactcactgtttactataaattctgacattttattcgtttgaatatccactccaacgactcgaaagccttctgttagaaattgctttaccgccgcaaagccgattccgctatttgccccagttatcattatattctttttcttcatcattttacattctgccttttttcactttggtaatttgtaataatctgaatattattatttgacaatatattacaaataatttagcattgcactacatcctctattttccacattttctatcatacaggaaattactaaaaaaaacatctactttttaaggagagattcatatggttcaagtttcaaacgtacaaaaagagttgacatccgatatttctaaatatgcttcttttttaaaggaaaacggctattcgtatatcccagcagatttctatcagcagaaaacaacagacgctgcagtccgcgaattacagcttacatatgatgatttgaaagctgattctaaaggaggcggccgttacagagcgcattcccgctacattttggctcctcactccgacactcttgaattagatccggataatggatatttccaatcaaaagaatataattatgatgatggcggtatcgtcagacaattcgaaaaaatatcagatgagtttctacagcatcctgtaacgcggcacatgatacattcaaatgtagaaatggctcgccaaaccgattttgtagattgggagaaagaagtgatcgtcgggcttcaccaagtcagatatcaagtgacacctgacgcgccttcatacagctcacccatttggctgcatcgtgacgatgaaccgcttgttttcgtccatctatttcagctgagcgaagatgctatcggaggagataacttaattgctccgtctgttaagcaaattgataaagtgctgcggctgacagacccgcttgagacacttgctctcgggcaaaaggtctttcatgcggttacaccggtcggcactgccaatagagatggtgcgcatcgagatatattattagttacattttctaacagataaaaaaagcgcccttgggcgctttttttacaaatctatcgaacaattaaaaccgggcatgttgataattgagacactttatggctgacgcttccaagcatcatttctttcaggccgctgatcccccggctgccaactacaatcaggctgacgcctttctcttttgcgtgatttagtatctcatgcgccggctcgccattcgcgtaaatggtttcagcttgaacgcctttttcggctgctttttcttttgcattctcaaggattttcaggccctcttttttaacctcgttcctgatttcatcaataaagtgttcaggcacatagacaattcccgtcagagaagaagtcgtgacgacggcttctctccccacatgaagaatgcttagttccgcttgttgctcttttgccaaatgcactgcggcatcaagcgcttttgcactcatgtctgatccgtcaatcgctactaacattttgttaaacatgctcttcccgcctttcggactgtgggtggttcatctttctcttttattgtccgcctgcatttcgttattgtcaattgaagcgcatgagttttcaaaaaattgtcagagactctctccgtttgtggcgatgacctgctgataccagttgaagctttttttcttgatgcggttaaatgttccatttccttcattgtccctgtccacataaatgaaaccgtagcgttttttcatttccgcagtagatgcgctgacaaggtcaattggcccccatgatgtgtatccgattaattcaacgccgtccgcaatggcttcgcgcgcttcaattaaatgatcacgcagatagttgattctgtaatcgtcctgaatcgtgccgtcctcttcaaccttgtctacagcgccaaggccgttttcaacaatgaacagcggcttctgataacggtcgtataaggtgttgagcgtgatgcgcaagcctttcggatcaatttgccagccccattctgatgatttgaggtaagggtttttgactccgcccagcaggttgccccctgattttgcaagctcttccggatctgtgctcgccgccatcgacatgtagtagctgaatccaatataatccaccgtatgttctttcaagagctcttcatcgccttcaaccatttcaatttcaatattgttttctgccagatagcgtttcatatatcccgggtatacgcctcttgcctgaacatctgagaagaaaagtgttttgcgctcattctccattgccgcgaagacatcctccggcttagaagtcatcggataggttgtcgttgccgctatcatacagccgattttcgaatcaggaatgatgtcgtgacccgctttgacagcaagagcactggccacaaattggtggtgtgccgcctggtacatcgcgtttaatttgttttctccttcttcaaaaacaagaccgcctccggtaaatggcgcatggagcactacgttaatttcattaaacgtcatccaatacttcactttgtgttgatagcgtttgaaaaccgttttggcatagcgttcataaaactctatgactttgcgattcttccagccgccataatttttcactaaaccgagcggcatctcataatgagagatggttacgacaggctcaatatgatgctttaacagctcatcaaacagatcatcataaaatctgaggccttcttcattgggctcctcttcatcgccattcggaaaaattctcgtccacgcaatcgatgtgcggaacgccttaaatcccatttctgcaaataaggcgatatcctctttataacgatgataaaagtcaatcccgttgtgatacagattcaaggaagtcattgattcatcaaatggagacatgatcccgttcggcgatacgtcagctgtcgaaagccccttaccaccctcgttataagcaccctccacttggttggcagcaactgcgccgccccataaaaatccttctggaaatcgtttttcatttgaactcatattgatcaccccattagttttttcaagataaagcaagcagcgcttcttttggctgcactttaccgatctctttcaccggcgaaaacgaatattggtctgtgttggtcacaatcaccggggtaatgacgtcatatcccgcggctttgatttgctccagatcaaaggacacgagcggatctcccggtgcgaccttgtcgccttctttgacgtgagccgtgaaccattgtccctccagcttcaccgtgtccaatccaatgtgtatgagtatttcagctccctgatcactcgtaatgccaattgcgtgttttgttttaaaaatggtggtaacgcttccacgaacaggcgacacaacttctccttcttcaggctcaatggcaaatccttttcccatgatcccggcagaaaatactccatctttgacttcacttaaggctttcacttctcccttaatcgggctgtgaatgatctctctgctgccctcatgcactgccggctgctggctgccgtcagaaggcacatcctcgaatccaagcaaatacgcagctgctgttcccgccgcaaacgcaatcacaaggccgatcatcgcgtaaataaacgttgggccgataaagacagggatgctcgggagacctgcattccctccgacgatataggaagcaacacccgtcatgccgtaaaacgcgccaccggctgcaccgccaatcaaagcggccgcaaacggctttttcaatcgcatattcacgccgtacatcgcaggttctgtgatccccatcagcgccgtgatgcttgtggtaagcgcgagtgatttaaattttttgtttctggagcgaaggaagacggcaaatgatgctcccgcctgccccatattcgccaaaaacatagccggcagtaaataatcgtggccgttttgagcgatgttgttgatcatgatcggcacaaaggcatagtgcatgcccgtcataatgattaaagagaatgtacccgccagcaaaatcattgccacaagccctgcatgatcaaacaaataattgaccccagaagacaagtattctcctaaaatagcgccaagcggaccgactgtaatcaatgtcagcggcacgacaatcaatagcgtgaatgtcggaaccacaatcaatttgagagatgcgtgtgtaaaacggtcaatccatttttccacgtatgaagcaatccaaatcgacagcaaaatcgggatgaccgttgacgaataagtggcagcggttacaggaagcccgataaaggaaatcggtttccccgcaccgagcagggctgtcaaatccggatgcaggatcgccgccgcaatggcagccgctacgtacggattgcttccgaattttctcgccgcactcatcgctagcaggagcggcaggaagtagaacgcaccgtcaccgacagccgtcaaaatgacatgaacctggctcttctccgccatccagccaaacgtaactgccagcgcaacaagccctttgatcatccccgctcccgcaatcgcaggcagaatcggggtaaacacaccagaaatcacatcaaagaccgcactcagcacattctttttctgagaggatgaaccagcgctcttttcatcactgagattgctgtgccgcacaatcgcctgatacaccttcggcacatcgtttccgataatgatttgaaactgctcgccgctgatattggtgcccatcactccaggcagctgctccaactgactgcgatccgccttcgaattgtcatgaagattaaaacgcagcctcgtcatgcagtggatcacgcgctgaacgttgtcttcaccgcctacgagttgtaatatgtccttcgataatttatcataatccatgtgtatacctcctttttatggggggactgctggaagaaaggtggccgcctttcaccagctttttttctatcaaatgctgcatcacctcctaaaagagaataaaaaaaacctaaatgacacagattgcgagagtctcctcctgcacctgcaccatttaggttttgcctgctttcacagtaacaatcctgacgggtcgttttatttgtttgtaggtatactttagcactagatttatcggatgtcaacgctttcatttttgagttttgactaaagggaattacttattgaggactgctttgttatagagggaagccattttgtatattttgttttatttttctgaaaatactatcaaatatatcagctgacttaatataaaagtaaaaaaccttgaaaggcaatttagcccatcaaggtatatgttttatttttgactatcccttttccatatactttctccgtcagttaaaaaaactgcacttggcggatcatcataaagtgaaatttcaactaatgaacctttcttttgtattaaccaattatataaactactttcttcactagtaggatgagctaaaatatcatttacttgaaatgtaactgcataatattcgataaaattcacatcatcgtcatccaacccattgtctgtttcaaagagtgtgtctggttcaccaataatctttaatccactatcccactctattatcaagtcactatctttatactcttttaacgcttttattaaaggatcatattccatgtatatcctcctcaagagaaaagtctctgcaatcatgccgtgagagtcagattctacagaggaaatcgcatgctgtgtttgtttcagtacttttttgtattcgtcgataaacatgccaaagaaaaggagaagggtttatgaattagctttataaaagattatttttattaaaaaaccttgaaaggcatatagccagtcaaggtatgataacaataacattatatttagaagtatcaactacttcacctactgatttatctgagagaatatcataattgttttatatattctttctaataaaataaggctattttaaagtaactccactccaacttgtttgcaaaatttaactttaagtctctcttcttgacccacattcattaccataactttgtcatctttttttatacttgttacattattaaaatcacctgtaaatactatagaatcattaaatgtaatacttagactactcgtttgcttatatacatctaaagttaaaatcaccttgaaattttggtcatctttgtaagtataaattaattctccatcatctatattgcctgttatactcaccggctcactttgaaaaagttctaatagatcatattcatcatactttataaacatttgtattcatccttttattaattatttcggtataactgtgataacatcgcctgcttcatttattattactttgacatccagtgtttcatgaacaaacgttccgcttctattaccaggtatctttttcgtattcattatagcgtcttcaataactgaaggtgaaatatttcttgggtcaacatattttttgataaaatcactaaattcttttgtttgtggtttatatcctaattcttcagcttttttaattgctctacttgttaaagtagcttttacttcaggaatatcaggtgccattctttccaaagcatgctgagaatactttcttccatttatttctcctccgccttttgacatgttccaaccaatttcacccttacccttagaagcaactttattaacctcacccttactttccttctccgcaacatgtttagccacatctgtgacaacacgcttcccgcctcggaccgccaattttttaatagcgccctgaggacttacccactcaataaattcatattgagttccggcaagaaacgaatcaattggcttagctccgcctactttatcctctggtatgtaagacacttcttctagccgctttttccctccagcatagaattctcttacgatctggccgttttcataaacataatatttgccgccgacatagtcgatgcttgcagtattgcgagttagttcgtcaatcacttctatcgtatctatcttttttaatcttttattattatatagtttatcatttatcacccgtatgtctccatagactttcgggtgagctgctgcttctttctgtaatacagttacgttactgtcatcagcatgaatctcacgctcgatcttctgttgtttgccatccttcatcacgatatcaacgttggactgcttatgtttctctattttcttcagcatcatctccatcggtgaatcatccggctgcttcatttgcgagttaatgccgccgaaggtttggttgatgttttcttcttcctgtgatttcaggatagagccgcttttgtagcctgtgatttcaattttcggaccggtatacatggttccgagctggtctatatattttttcatcgtttgaaaatctgattttgcggtttctaatgcttgggtttgctggccgtcaaattgaaagagcttattcagggtgtctgaaatcagccgctcagcctgttctgtttccatccgaaaaaaggaatcattgactgtcggcaggctgacgatgtgatcgatggctgatgtttggcgattgactgcgtcagtgagctgctctgtcacttctcgtgcatgcttgaccccatgtctcgcatcgtgtgagagaaaagcctctgcgatcatgccgtgggagtcagattctacagaggaaatcgcatgctgggtttgtttcagcacttttttgtattcgtcgataaacatgccaaagaaaaggagaaaaggcttgtggcactcctcgtaaaaggtccggatggcatctccgccttttcctttcagcgcatccctcatgcctgccagatgctcaacgcttttttccagcttctccagctgttgtttttgcttgtccagtttctcaatcgtatgctgaatgccctcgtgaagagcgtggacatctaatgttttcaatcccttgtcctcccgcgctttatttcatggaagatgatatgttttcgtccgtttccttcatggcgtttaccgcgctttccgtttgtgcgatatgcttggccagaacagacgcatatgcttcagtgagctctttgatgtccttatttaattgctcgatggacttcacaacattcaaatggtttctgcctgagagatggccgggtaaggaggacttgagttcagctgaattcttgagctgagaaagcccttgcttcactgtgccatacaccattttaatttcctgtgccatttgtgctcacctcactttttatgtttttctttctctatttcatgctctatcctcgtaatttggcgtcttatggaatagacatcgccctctaatgagtggatttttccttctatgctttcgatgattccgttgacttgatcgcttttgatttgctgatatgctttgttcattccttcacgaatatcttcaaaccgctgagcatgtgttcctctccatgcctcccggttaagatgaggccggtgaatgagatgctgggcctcggagaattcgtgtttgatttgcctgatttcgtgcagcactcgttttaattgatggatctgttcctgcttttcatgtaagtcggcttttaccgaatgtaacaacatttcactatgcatgccgcaacacctcgtgtttctatcaaactgtgtcaattctttacaatacagactattttcatattacatgatgggtcatattggataaataggtaaaaaggattgtcttgaggaactttataccggttctaaatagctaaaaattcaatttcataactttgtaagagggagaatcatcatattggggacttttcgtttaggtcttgaaccccgcaatcacttctgttttttctctcgctcaaccatttcttatagtcaataaagctcataaaaaagcgccttctctagaaggcgccttctccatcttatttagatccccatacagcctcaccgttgccattcaaaacactaaacgtcatgacgttcttctctctcaccgaatcccactggcgtaaaaataccccgttatacttcttgccagctaacgtgatgtcgactgtgttttttccggttttctgccatgttccggtcatttccccggaaatggtgtggtttttgttgagctggataatgatggtttgtttgatgtcggctgagatgtcttttccgtgctggataagtttgtatgttcctgtgatgtctttttgttttacttctttcaatgtttcgcccgcataacgatatggtgctgctaccggccagccgtctttgttcatgaacaattggtggactctgacttcgtgttcttcacccctgcccgggaagcgggtgtggaagattaaataggaacgcccggttttttcatcatagtatgcggagttgtggcctggtgagacgtacccggtgcctttttcattttctgtttcaaaagtgtagctgcccatgagtttgacgccgtatggttcgatggaacggtcgtcgaagaatgtgccttctttgccgcggacgtcaagcattggattgccttctgcatcatagtaagggccgtctggtttcttggagcggaccacacggatgttatagccgcctgttgcatcaagaccgccatatgataggtataagtagtagtatttggtgtctggattgtagagaacatacgggccttcgattctgctatggttgccgccgagcagttttttcccgtatccctgtccaggaagcgggaagcccgttttcggattcatttcaagtatgaaaatgccgcctgagtatgatccgtacaccatccacagcttgccgtctttatcaaagaaggtatgcgggtcgacgacattcggatgtttggttgcgtcatacggtgttccatcgttgcttgtgccttccattcctgatttcaaaaagatgcctttgtttttgtatgggccttcgatgttgtcagcaacggcaacacccatggcggatcttggcgaatcgccgcggcaggcgttgtagtacatgtagtatttgccgtccgccagctgcgtgacgtcagccgcccaaagagtatcggattgcgcccattcgaaggtttcttttaattctttatagacattcgggataagtgggttgtcattgcttacgctggtggtcagctgctgccattgcatgaggtcattcgatttagctgaagcgagatgagatccaaaaacataaaaagtgccgtttgtttcaatgatggaagggtcatggacgctgacttctttaaatataggtttttgtgcatagacggagtttgggagggtgaaggccatgataagagctgcaagaaaacatacacagaacaatcggttgaacatctaaacaattcgcctctcttttttattaaattttaaacgcttacatttccctatgaagataccccggcctattaaaacagccgaatgttttcatattcaaacagataggtgatttctcactgttctcttacatagtcagactgatgtctgtctgttttgcgcagaactgctgcttgcatacctctattcatagttcaacccttttgccgtttctccttcttcaattacttctgtttcttcatttgcgtacataatgaacgctttgtccggtcttgtaaagtcgtcgacttttctccggcaacttcgcctctttttggcattttacctctcattgtcagcaatatgacagcggccgcttgcacttctgtctgggtatgcgtgtgcaatgtgctgctttctgcgtcacactattacaatagcaatctaacttgttaaagactgtaaaaaaccttttgacttctgctgctgaaccaattaatataatactcagttaatagttatcagaatttttaggaattgagtgattcatatgacactgcataaagagcgtcggatcggccggctgtctgttctcctgctgctgaatgaggcggaaaaaagtacgcaggttgaggagctggagcgagacggatggaaggtctgtcttggcaaggtaggatcaatggacgcgcataaagtagtagctgcaattgaaaccacttccaaaaagagcggtgtcattcaatctgagggttatcgggagtcacatgcgctttatcatgcgacgatggaggctttgcatggcgtgaccagaggtgaaatgctgctgggatcgctgcttcggacggtgggcttgaggtttgccgttttgaggggaaatccttatgaaagtgaagcggaaggcgattggattgctgtctcgctttacggaacaatcggggcgccgattaaaggtcttgagcacgaaacattcggtgttggaattaatcacatatgaaacagcccatagatcttagacaatagggggctatgcgtgaaaacagatgttcacagcatagctcctttttgtatgggcgctttaccaaagtaaagaaaaaggagttgggcttatggtgactttagacggttcttcattgacaacagccgacgtcgctcgtgtgctgtttgattttgaggaggcagcggcttccgaggaaagtatggagcgcgtgaaaaaaagcagagcggcagtggaacggattgtacgcgacgaaaagacaatctacggcatcaacaccggatttggcaaattcagcgatgtcctgattcagaaagaagactcggcggcgctgcagctgaatttaattctttctcatgcctgcggagtcggcgatccttttcccgagtgtgtgtccagggcaatgctgcttttgcgcgccaatgcgctgttaaaaggcttttccggtgtccgcgctgagctgatcgaacagttgcttgcttttttaaataaacgcgtccatcctgtcatccctcagcaaggatcacttggcgctagcggagatttggcgccgctttcccacctggcgcttgcgctgatcggacaaggagaagtcttttttgagggggaaagaatgccggcaatgacaggcttgaaaaaagcaggtattcaaccggtaacgctgacatccaaggaagggcttgccttgattaacgggactcaggccatgactgcaatgggggtggtcgcctacattgaagctgagaaactagcctatcaaacagaacgcattgccagcttaacgattgaaggtttgcggggaattatcgatgcatttgacgaggatattcactcagcacgcggctatcaggagcagatcgatgtcgcagaacgaattcgcttttatctatctaacagcggcctgacaacctcccagggagaactgagggttcaggatgcctattcattgcgctgtattccgcaagtacacggtgcgacttggcagacactaggctatgtcaaagaaaaattagagattgaaatgaacgcagctacagacaatcccctcattttcaatgacggtgacaaagtgatttccggcggaaactttcacggacagccgatcgcctttgccatggattttctgaaaatcgcaatatcagagcttgcgaatatcgcagagcgccggatcgaacgacttgtgaatccgcagctgaatgacctgccgccgttcctgagccctcatcccggtctgcaatccggtgcaatgatcatgcagtatgccgcggcctcactcgtttctgaaaataaaacactggcccatccggcaagtgtggattccattccgtcatccgccaaccaagaggaccatgtcagcatgggaaccatcgccgctcggcatgcttatcatgtgatcgcaaatacaaggagagtcattgcgatcgaagcgatttgcgcattgcaggctgttgaatacagaggcatagaacatgcagcgtcctatacgaaacagctttttcaagaaatgagaaaagtcgtgccgtccattcagcaggatcgtgttttttcctatgacattgaacgcttgactgactggctgaagaaagaatctttaatacctgaccatcagaataaagaactaagggggatgaacatatgactgatgtaaaaaaatcaatccgtgccaacagaggaacagagcttgaatgcttaggatgggagcaagaggcagtgcttcggatgcttcgaaacaaccttgatccagaagtcgccgagaagccggaggacctcatcgtatatggcgggattggcaaagccgcacgggattgggacgcttttcacgccattgagcattccttgaaaacattaaaaaatgatgaaacattgctcgtgcaatccggaaagcccgttggcatgttccgtacacacccgcaggccccgcgcgtgctcctagcaaattctgttcttgttccgaagtgggcagactgggagcatttccacgaacttgagaaaaaagggttaatgatgtacggacagatgacggctggaagctggatttacattggctcacaaggcatattgcaaggaacctatgaaaccttcgctgagttggcgcgacagcacttcggaggcagcttaaaaggaacgttgacgctgacagcgggtctcggcggaatgggaggcgcacagccgctgtctgtcacgatgaatgaaggcgtcgtcattgctgtcgaggttgacgagaaacgcatcgacaagcggatcgaaacaaaatactgcgatcgaaaaacagcatcgattgaggaagccttagcttgggctgaagaggcaaagctggcaggaaaacctttgtccattgcacttctcggaaacgcagctgagatgcatcacacaattttgaaccgaggcgtcaaaattgatattgtgacagatcagacatctgcccatgaccctttaatcggttatgttcccgagggctattcccttgatgaagctgaccgtttgcgtcaagacaatccagagctttacgtgcgccttgcgaagcaaagcatgaaaaaacatgtcgaagccatgctggcctttcagcaaaagggctctattgtatttgactacggcaacaatatccggcaagtcgcaaaggatgaagggctggagaatgccttcgattttccggggtttgtccctgcctacatccgccctttattctgtgaaggaaaagggccgttccgttgggcggcgctttccggagatccggcagatatttaccgtacggatgcgttattaaaagagctgttcccgacaaataaagcccttcaccgctggattgatatggcacaggaaaaagtcaccttccaaggcttgccgtcccgtatttgctggcttggatatggagaacgaaaaaagatgggcctcgccattaacgagctggttagaagcggggagctaaaagcgcctgtcgttattgggagagatcatttggactgcgggtctgtcgcctctccaaaccgggagacagaagcgatgaaggacggaagtgacgctgttggtgactgggctgtgctaaatgcgcttgtcaacacggcggcgggtgcaagctgggtttctttccaccatggcggcggcgtcggaatgggctattccctgcatgccggcatggttgcagtggccgatggaagtgagctggctgacgagcggctcgcgcgggtcttaacgagcgacccaggaatgggcattatccgtcatgcggatgcgggttatgaacgtgccgttgaagtagcgaaggaacaggacattatcgtgccgatgcaaaaataaaggagtgatgacatgccaaagcaaattgatacgattctcatcaacatcggtcagcttttgacgatggaaagcagcggtccgcgggcaggcaaaagcatgcaggatcttcatgtgatcgaagacgctgttgtcggcatccatgaacagaaaattgtgttcgccggacaaaaaggggctgaagccggttacgaggcagacgaaatcattgactgttcgggacgccttgtaacgcccggcctcgttgatccgcacacccatcttgtatttggcggatctcgtgaaaaggagatgaaccttaagcttcagggcatttcatatttggatattctggcgcagggcggcgggattctgtctacagtcaaggataccagggcggcttcagaagaagagctgctgcaaaaagcccattttcatctgcaaagaatgctgtcctacggctcaaccacagcagaagtgaaaagcggctacggcttggaaaaagagacagagctcaaacagttgcgtgtcgcaaagaaactgcatgaaagccagcctgttgaccttgtttccacatttatgggagcccatgcgattcctcccgaatatcaaaacgatccagatgaatttctggatcaaatgctttcccttttgccggaaatcaaagagcaggagctcaccagctttgctgatatttttacagaaacaggcgtttttacagtcagccaatcccgccgttatttacaaaaagcagctgaggcaggcttcggattaaaaatacacgcagatgaaatcgatccgcttggaggcgctgaattagcaggtgagctaaaggccgtctcagccgaccatttggtaggtgcatcggacgaaggcataaagaaattggctgaggcaggaacgatcgccgtcctcttgccgggcacgacattttatcttggcaaaagcacatacgctagggctagagctatgattgatgaaggtgtatgtgtcagcttggcaacggattttaatcctggcagctcgccgactgaaaatatccagctgattatgtccattgccgcgcttcatctgaaaatgactgcagaagaaatttggcatgcggtcacagtcaatgccgcatacgccatagggaaaggagaggaagccggtcagctcaaagtcggccgctcagctgatctagtcatttggcaagcctcgaactatatgtatattccgtatcactacggggtcaatcatgtacatcaagtcatgaaaaacggaacaattgttgtcaacagggagggagccattcttggataagtacccttttctcagagaggccggatcttcgtttaaagaccgggatgtcacaaaaatgagcgacctgatcgcaacatgggacggccaggacattaagggaccggcgttgataggtgtccccctatcaaaatcctccatcagtcattcaggcgcttcctttgcacccggaacaatacgccaggctctgaaacattcatcagcctattctgctgagcttggagagcatgtcgtatcagagcttctatatgatctgggggatatcgatattcatgtcactgatatcgtaaagtcacatcatcacattttccaaaccatgcacgctctgctttcggaccatcccgattgggtgccgctcatacttgggggagataactctatcagctactccacaataaaagcgatagcacaaacaaaaggaacgacagcagtgattcaatttgatgcccatcacgatgttcgcaatacggaggacggggggccgacaaacggcacccccttccgccgccttttggatgaagagattattaaaggccaacatttgatccagctcggtatcagagaattcagcaacagccaggcctatgaagcatatgcaaaaaaacatagcgtgaacattcacacgatggacatgatccgggaaaaaggactgatcccaacgataaaagagattttgcctgccgttcaagatagaacagatttcatttttatatctgttgacatggatgtcttagaccagtcccatgcacccggctgtccagcgattggcccgggcggcctctatacagaagaattgcttgaagcagtcaagtatatcgcacaacagcccaatgttgccgggattgaaattgttgaagtcgatcctaccctcgattttcgagatatgacaagcagagctgcagctcatgttctgttacacgcattaaaaggaatgaaactctccccattcaagtgatcttctggcaggttgtattttgggtataagaaactcatctgcctaatgaatggcagctaaaaggagggcgagacagtgaatcttcaggagaacagcagccaacagctaaaacgcacaatgaaaagcaggcacctatttatgatctcattgggaggcgtcataggcacaggacttttcctcagtacgggctatacgctacatcaagccggacccggcggtacgatactcgcttatgtaatcggcgggttgatgatgtacctcgtcatgcaatgtctcggcgaattgtcggttgccatgccggtgaccggctcttttcaaaaatatgctacaacatttattggtccatctaccggttttatggtcggcatcatgtactggatcaattgggtggtgacggtaggctctgagtttaccgcatccggtattctcatgcagcgctggttccctgacagcagtgtatggatgtggagtgcgatttttgcagcccttctttttatatgcaacgcattttcagttaagttatttgcggaaactgaattttggttttccagcgtaaagattgtcaccattattttatttatcattctaggaggagccgccatgtttggcctgatctctttaaacggaacggcggatgctcctatgttgtcaaacttcacggaccatggcgggctgtttccgaatggctttcttgccgtttttatcgcgatgatatctgtgagttttgccttttctggtacagagttaatcggcgttacagcaggagaatcagcaaatcctcaaaaggatattccgcgatccatccgtaatgtcgcatggagaaccgtgatttttttcattggcgctgtcttcatattatccggattgatttcgtggaaggacgcaggcgtgattgaaagcccttttgtagccgtatttgcggagatcggaatcccttacgctgctgatattatgaatttcgtgatattaacagccttgctgtctgtcgccaactcaggcttatatgcttcgacccgtatgatgtggtcgttagcaaatgaaaacatgatcagctcccgttttaagaaagtgacctctaaaggcattcctttaaatgccttaatgatcagtatggctgtatcttgtttatctctcgtttccagtatcgtggcccctggaactgtctatgtggtgatggtcgcaattgctggatttgcaggagtcgtggtctggatgagcattgccttgtcccaactcttgtttcgaaagagatttctgaaaaaaggggggaatgtaaaagatctgacatttcgcacgccgctttaccctcttatgcctatagccgctcttttattatgctcagcttcttgtattggtcttgcttttgatcccaatcaaagaatcgcacttttctgtggagttccttgtatcatcctttgctatctgatctaccatttcaaaagaaatgtttcaaaagcgaaaaaaatcagccaagaggaatatccggccgatcacatcctgtaattaaaaaagcacaccccgctcaggatgggatgtgctttattttttattcagtaatcaacgtatgaatcagcttcggcgccttcgcttccgcggcgaggcggatgttgtcatagacttttgcgatgacttcatcgacgttttcgcggttggcgtaaagcgtcacgagcggttcgcctttttctactttgtcgccgacctttttgtggagcatgatgccgacggctaaatcgatctcatcttcttttgtggcgcgaccggcacctaacagcatcgccgcgacgccgatttcgtccgcaacgatttcagagacgacacccgcttctttggcaggcacatcaatttgatatgcggcttgcggaagcttagacggatcgtcaacaattgagctgtcgccgccttggtttttcaggaaatccttgaatttctcaagtgctttgccgtttttcatgacttcttccagcttcgctctcgcttcgtccaatgtatcggcttttttcgcaagcacaaccatctggctgccgagcgttaagacaagctcatgaagatcctcgggtccctcgcctttgagcgtgtcgatcgcttctttgacttcaagcgcatttccgatcgcaaagccgagcggctgggacatgtctgaaatgacagccattgtttgacggccgacgttatttccgatgcgtaccatcgctttggcaagttcagctgcgtcttcttctgttttcatgaaggcgcccgctcccgtttttacgtcaagcacgatggcgtccgccccggcagcgatttttttgctcataatcgagcttgcaatgagcggaatggaattgaccgttcccgttacatcacgaagcgcgtacagttttttatcagccggcgttaaattgccgctttggccgatgaccgcaaccttgtcgcggttcacaagtttaataaattcatccttcgtcagttccacgtggaagccgtcgattgcctctaacttatcaatcgtgccgcccgtatggccgaggccgcggccggacattttggcaaccggtacgtcaagagccgcaacaagcggagcgagaacgagtgttgtcgtgtcgccgacgccgccggtggagtgtttatccactttaattccttcaatggcagaaagatcaatcgtttcaccggagttcaccatagccatcgtcaagtccgcgcgttcacggtcactcatatcctggaagaaaatcgccatagcaagcgcgcttgcctgataatcaggaatgcttccgtctgtatagccgttcacgaaaaattgaatttcttcagtggtgagttcttttccgttttgttttttgatgatgatatctaccattctcatgtttggtcaccgatccttttcgattaagttcagtaaatcaagcccacaattgctgctgataaaaagctgacaagcgtagcaccgtataataatttcaagccgaaacgagcgacgacatttccttgcttttcattcagtccttttacggcaccggcaatgattccgattgaggagaagttcgcaaatgacacaaggaataccgatacgatcgctgttgtacggccgctgaaatggaaaccgttttgcgtaagcgacgtcatggcgacaaattcattcgataccatttttgttgccataatgcttccagcattaacagcttcattccatgggataccgacaagaaaagcgaatggagcaaacacatatccaagaatgccttggaacgaaataccgaatactgcattaaaaatgccattgatcaaggcaataatcgcgacaaatccaatcagcatcgcagcgacgacaaccgctactttgaaaccgtcaaggatgtattctccgagcacttcgaagaaggattgtttttcttcttcctcaacacgaagcatatcctcttcttttgcaacctcgtacggattaataatagaagcaattatgaaaccgccaaataagttcaagaccagcgctgttacaacatattccggtttcagcatggtcatatacgcgccgacaatcgacattgacacagttgacatcgcagatgcgcaaagcgtgtacaagcgctgctgatttaaaagaccgagttctttcttcaaggagataaatacttctgactgccctaaaatcgcagaagccactgcgttatacgattccaatcttcccataccgtttaccttgctgagggcaaggccgatatatctaatgataaacgggaggactttccacttttgcagaatcccgatcagagcggaaataaacacgattggcaagagaacattcataaagaatgtcgtttggtccgcattcaccaagccgccaaacacaaagttaattccctcagccgcgtattcaagcagataaccgaatccttttgcaaatcctcccacgagaaaattccctatcccggtattgaggagaatgtagccaagaataaattgcaaaatgagcataacaacaattgggcggatcttaattctttttttgccgctgctcgcgatccacgcgaggcctaaaaacacgattaaaccgataatcccaatcaaatacttcatatgtgtttctcctttatttgtattcgcttacaatcactgtttcctcagaaaacggaaagcagtctgccttccgtcagctcttaatagttgtctccgcctgatgcattttctccttttacgatagaaacgcctgcgctggcgccaattcggcttgctccggcctctaccattgtgtctacatcttctttcgttctgacgccgccagatgctttcacgccgatatcaggtcctactgttttgcgcattaaggcgatatcttccttcgttgcgccgcctgtagaaaagcctgttgatgtttttacgaaatccgctcccgcagacaccgctaaacggcatgcacgttctttttcttcatcagtcagaaggcacgtttcgataatgactttgacaagcgcttttccggctgcagcttccactacaccgcggatatcagcttccaccacatcgtcttccttgtcttttaaagcggcaatattaatgaccatatccacttcagtggcgccttttgaaatggcgtcttttgtttcgaatgcttttgtttcagttgtattggcaccgagcgggaagccgatgaccgtacaaacgtcgactccagttcccttaagctcttttgcagcaagctccacccatgtcggattgacacatactgaagcaaatttgtatgttttcgcttcttcaattagttttagaatgtccgctttttgtgtatgcggtttcaaagctgtatgatcaattatgttggctaatgacatccttcgcacacttccttttttgttaagatattttttagcataaccgacttttgaacatatgtaaattggtaattgaaattttgttcaacgaaaggtttgaacgtgtcacaaatcattaacaagcgccctcgcggtatgctggtcaatgattaaaacgttggcatattttccggttaatgctccgtgaatggaagatacttttctgcttccgccggcaactaaaatggagcgttccttcagcctgaggtcttcaagctcaacaccgatggtccggtcattgatggcgctgctgcaaatattccctttcgcatcaaaaaagcgtgaacaaatatcccccacggcctgttttttcagcagggctttctcttcttcgttaaaatatccgagtcggaacaacagcgcttcatcacggacagtccccaccgtgaagagagcaatattcgcctgctttcccatctcgatgatccgctcaatatgacggtctttctccaccattcgcttcacatccgcattatcaaacacgacgggaagcggaagatagcgcggcatcgtttgaaaagcctctgcaaacagctgaatcgtttcagccgaatacgtgtttacccgggaatggctgatgccgccttttagctggacgacctcgacgccttttacctgcttcggttgcatgttttgcgcgatttgatacatggtggttccccagctgacgccgacaatgtcgccgtcttttaccgtttcatgcatatattctgcaccatagcggcttaggtcatgtgtaattcctgcataatcgggtgtcggggaaaacacaacatgcgcctcaaggagcccgtatttctcttcaagtatggaaccgagcgcatccaaatcctcaaaagggtccatgacgcgaatctggacataccctttttcctttgcatattgcagcagccgggaaacggttggccttgaaatgttgagctgctcagcaatttgctgctgactgtagtcagactgatagtaaagccttgccgcttctatgcttaattgttgtttttcccgatccattccgcacctccctgtggatcagtcctgataaaactgcttttgatttgcttttattatacaggctggcgccggctttcatccacctgatttctaagaaactgaaaaacgctctgggcgcggacctgcccagagcttacttctcccaagtcatatgctgataaatgcctttcataatggcgtacattccatataggatcaggcctaatgccaatatagacagaatcaatttgccatgcggctgctgcgcgagttcggcgagcgcgccgtcaaagcctcttgtgtcgtcgggatcagcggtcatggctgtcttgatgagaaaatagccgatggctgagaaaataatggcgcgggcgatattgcctgcgcgcccggtgtttttcgtgatgcatatcatctgtttgttcatttttgatgtatcgaattctttcataaaagcagcccgaacgcctttcataaattgaacaatcgcaaatacgataaaacccgcacccgtaagccctgtgagccatcggccgaatggctgcgccaatacataagcggaccacgtctgttctgaagtgccgccgtccccttggccaaacacaaatcgcaaggcattccaagcgatggatgtgtaaacggcggcactgaaaaagtttcctattctccgtgacaggcctcgcctgctatttccgtgcccctccgtgtccttgatcgcacttaacaccatccagattacatagccgataaggccgatgcctattaaaaaaagcaatagtgacccatacggcatgcgtgatagcgtttggagagctccgctcgaatctttggcgcggcctgccccggcagccgtcataaaagccaaaaccccaagcagaataaaaacgccgccgaatgcaaaataaccaagcctcccgaatcgtttgatccaaggcttggtttcctgttttatttttgacatgtaccggtctttcaccgccatgtgtccaaccctctttcacagaaatctttactgtaacattcccgattggacaaagttgaaacagcttctgcctcagctatggctggctgagatatgtttttgctgtttagctgattgtgcaggtgtcatccaagcagccgctgcggcagctgtgactccgcctgctaatttcccaatgatcatggccgccgccatttcttttttcattccagccacaaaaccgaggtggctgccgagtacaaaagcgccgctgaccgcaaacgcgacattgatgacctttcctctcggcgtcatatcctttaatgaagccagcattgggatatggtgcgccaaagaggtcaccaagcctgcagttgctgtctcatctaaatgaaggcatttccccagagcctgtagcggttttttaaaggtttttgtaataaaagccgtcattggaaacgcccctgccaaggcaatggcgatggtccctgttgtttgtatccctgtctcgacattctccattcccggaatcagcacaataccggtcatcgtttcaacggagacagctgcaagcccgataatcgcaaccacactgaccgctttcccgaagagatgaaacaactgaatcatactgtcggtgtatcgccataacccaaaagcgatcacagcagataacagactcgggatcagaaggtttttacctatcatgccgatgtcaaagcctgcgcataatccgccgattaagcaaccgatcggcactgtgcacagcccgattaatatgcctttcgcaaaatacggatgatcctctttttcgatgatgccaagagcgacgggaatcgtgaagacgattgccggtcccatcattgttcctaaaaacacccatgaaaacagcccggcctgcggatctttcgccatttctccagccagcgcatatcctcccatatcaatcgccaaaatggtgttcgcaaaggaagaagggtccgcgccaatcgctgtgtaaaacggagcaacaatgggaatcaggattgctgccagcacgggcgccagcgacacaattccgatcatggacagcgccagcggccccatagccttaaagccgtccgcaaaccgctcgcctagcccccatctgtttcccaaacaataatccgccgctccccatagtaaaaaggcagccaaaatgaatacaaccgtgtcattcaccgtcatggttttctcctttttcaaacgtatgattggttttatcatatcatctgaaatcaccgaatagagttgatcttattcaatatgagctaaaaattcttttatatcggctttttcaacggctgttatgatgctccgcgctttttcttgcgggaccgttaatgtcaatttttctattatgtcttcttcagacagctcatttcctggcgccccttttgggcagtccacacgcgcttcgcaaatccggccgtctgataaataggcccggacaatcgtgaaacggccttttggaacggcatgaggagccggctgaatagcattgtcatatacgcgctgaattcgccccattgtcgtttgaaccccgcttgggatcggctggctgctgaaatgttcaacggtcaggccgtgtccatgcaaagcaagagcaatcacatattcaacgctgaaacggccttcctctccagtttttggagatctttccgtcaatgcagcatctccgcctggcggaaatatcacttcaatacgttcggtattggcagcagaaatggtttcttcggagataagctgtcgtaccgcatctgcagcatggtgtgccgcggaacaaaatggatagattttaaaccatagacccggctgcacaattctccacggtgccccccaatcgtttagcaaagtgtgttgtgctttctcaacgtcaccgtacagactgaagaaaccagtttctccatcaaatgccgtgcgggacccgccaaattctgattgggccagcttaacggccagcaagccagcctgagccgccaaaccggcgtgcagcggtttcatttctgttccaaattgcaccctcatcccagcagattgcgtagccgcaaaaccaattgctttttccagctcttcctgagtcagctcctcagcataacctacggcgcaggcagcagcgatggcaccaagcgttcctgtattatgccagcccttttcatagtggcggctgccaattgattctcccagccgtgccatcacttcaacaccaacaatataagcgccaagaagccgctcgtcatgtccgcgagcggcagatgcaataagggccggtacgatgactgcactggggtgtcctcttacatcggagtggacatcatcaaaatccaatgcatgggcgataaatccattgagcatcgcggattgtaatggcgcggcctttttgccctgtccgataataggaacaaggggcaggcctccttcatcctctatcagacggaggagcttttgaattcctttatcttctcttcctgcgaatgaagcggcagtaaaatcaagtaatcccttttttgcttcgtgaatcgcgtcaactgaatgctcaggttgtgacgttctcacagcctctgcaagacctgctgtcagcccttgtttgctcatttgatggtctccaatacaataaccgccagctccgcaaagtattgagaggcaaccgtaagggcttcttcatccagtgtaaaggccggatgatgccactcctccgtcccgttcgttcccatccagacaaaaaatcccggaatcttctcttgatacagagcgaagtcttctccgcccggagactgctcagcgtgaacggtttgatagccaagccgtgccgcagcttcggatgccgcattcaaaaatgtgccgtcattctgaacggaaggcaaataaggaaaccacttgaattctgcttgtgccccatagcccgctgcaattcctttagccactcgtctcatatgctcgggaacagcctgcctcgcttctttttgaaaggttcgaaccgtcccttccatttcagcttggtctggaatcacgttccacgacgtgcccgcctgtactcttgtgatactgacgactgcgttttgcagtgagctgatattgcggctgaccacagattgcagcccgctgatgatttgtccggctgcagcgattggatcaatactgttatttgggatgccggcgtgtccgcctttccctttgatgacgatctcaaaccggtcaacacttgccataagcggaccttcctttacaccaatggttccgacaggcagatccggcttattgtgcatgccgaaaatcgcggaaatgccatcaagtacaccagcttctatgacctttcttgctcctgcggcaatttcttcggccggctgaaagataaagcggactgtacctttcagctcggcctttctttgattcagcaacatcgctgtgccaataatagaagcagtatgaaaatcgtgtccacatgcatgcattgtgccatcaaccttagatgcaaatgggagattcgtctgttcttggatcgggagcgcgtcaatgtccgctcgtattgctatcacggggccgtcttcccgtcctttgatttctgcaatcacaccagtctccaattgaggaacatcaagtatttcgatttgctcctcctcaagccagcggcggatttttttcgtcgtttcaatctcttgaaatgacagttcaggatgttcatgaagatcacgccgcatattgattaaacgggtatgaaacgttttgtcggccattgttcttctctccttcttatataagctctgcaggctctcccacctgcttgataaatcgtttcgtccgttcgtttttcggatggtcaaacaattcctctggcgttccctgctcgataatatggccgtctgccataaaaatcactttatcagcaacctcttttgcaaacgccatttcgtgtgtaacaatgatcatcgttgtttgtttttccgcaatggacttgatgacctgaagcacccctgtgacgagctcagggtcaagcgctgacgttggttcatccagcaaaatcgcatgcggattgaccgcaagcgcccgcgcgatgccgattcgctgctgctggccgccggacattgtgatcggatagctatcagccttatgctccagaccgacttgtttcagaatctccattccaatacgtttcgcttcgtcgcgtggtttatgttgagccacgattaaagcttctgtaatgttttgcagagccgttttatttttaaacagattgtagttttgaaagaccatggccgtttgctggcgaagccgatatgcttccttgcgtgtaaacttttccgcgttcagtttggcttctccgatttcaataagtccttgatccggacgctctaataaatttaagcaccggagaagcgttgactttccggaaccggacggaccgatgattgccaccacttctccgcgtttcacttctagatcgattccgtcgagcacgacgagatctttaaacgctttgcgaatattttttactgttatcaactgatttcacctctaagtccggtatggcttgctcatggcacgttcaaacaagtcctgcaacatgctgtagatcatggtaagaacccaatagacgatcgcaaccgccaagtacgtctcaaaatatttgaggtttcctgaagcgtacatcttcccttgggcgaacatctccatgacccctaatgtaaaggccagtgacgtttctttcaggagcccgataaatgtattgcccgttgccggaatcgcatttcggatcgcttgcggcaaaataatccgtctgtatgcctgaaattttgtcataccgacagacaggcacgcctccagttgcccgtcatcaacagaattgagggcagcccggaagatttctgccaaatatgctgcattttttaagcttaacccgatgatagcggctgtgagagctgtcattttgctcatctctggaaatagctgcggcagcccgtaatagattaagaacagctgcaccagtgtcggtacgcctcggaaaaaggatatatacagctttgacagctgatgaagcactggaattttgttctttgtaatgagtgcgagaataagtcctccgataatggcaaaaatcatagctgctatggccataaacaacgtgatcggaagggcctgaattaaagtcgggaacgctgatatcatgaattcccaatcaatcgtgttcattctggtgagtcaccgccgtttcttaatgcttctgttctactgtgatatcttcattaaagtatttttcagagagttttttcagtgttccgtctttacgcaattcatctagcgccttattgacttttttgcggagcttgtcgtgcgcatcgtccttggcaaatgggaatgcaacctgttcgtaaacaatcggatctcctgcaagctttaatggcaaaccggtcttcttgatttgcgcgatcaatacagttcggctgttgacataagcgtctacacggccgtacgcaacatccttcagcgtaccctcttgtgtttcgtacgttttgatattgatttttttatcaggatctttgctttcaaggtttttcgcgtggtttgaaccgagaacggctgcgactgtcttgccttttaaatcgtctactgatttgatgtctgtattgtcttttttgacgacaatctgtgttcccgcataagcgtatggtttcgtaaagttatacgtttccttacgttcgtctgtcacagctacctggttagaaatggtgtcaagcttgcctgtttgaagctcccccatcagcccgctgaattcaagcagcttccagtccagtttcatgtcaattttcttagcgaccgcttccatcacttccacgtcaaaacctgtcagctttccgttttctttataagcaaatgggtaactttgtcctgtcgcaccgacatgaagcacattgtcatcctctttactgctgctgtttccattgccgcaagctgagagcaccgctaataatgcagcaacgaccagcacaatccattttttcattttcatttgattttcccgccttttctttttttatagatcatgtcgcaattgttttttcatatagactgtgatatgcccttttccaaggtcttgttcacctgagcggacatacccttttcgttcgtacatctctatcagccacggatgcttatccgctgttccgagtgagacaaacggaacctttaacgtatcgcgaaggattgtttcctccagccattgaagcagctttgttccgattccttttttaccggtgtcggggtccacagcgaaccaccagatatgcggaacgccatacggtcccggctgttttccccaaggcattctcaaggtgatggtcgcgatgatccgcccgtcttcttccatgacgtagcaagcgtttttccgaatattttgcagcaccaaatctaaatccgcatgagcagcagcaaaacgaatgccaagctttcgaatcggttcataagcccgcaatgtcagcgcgaggagctgttcagcatcacgttcaactgcaaggcgatattgtggcttcatctagcgttcctccttactttgcatagcggtttaccggcttttccaaaccgaagtgctctcgtaatgttgtgccttcatattcttttctgaacacgccgcgctcctgtaaaatcggaactacttgatcaacaaacacttcaattccttctggaagaagcggaggcatgatgttaaacccgtcacacgctttcttatccacccattcctgcatcttgtcggcgagctgctccggcgtgccgacgaagatatggtggcctctggagcctgcaacgtatttgtaaagctctcgtatcgtcatattgtccctttcagccatttcctgaacaagcttgaagcggctcttcaccgcattagaagcttctgcgtcaagcttcggcagcggcccatcaagcggatatgccgacaaatcaattccgcctaagtaattttggagaatttgcagaccgacagatgggataatcagatcttgaagctccttgtatttggcttgcgctgcttcttctgtatcggcaatgattgggaaaatacccggcatgatggcaattttttctggatcacgtccgaattccgctgcctgttctttaatggattgataaaattcctgagctgattccaggtggttttgtgctgtgaagatcacttctgctgttctggcagccaacgcttttccgtctcctgatgatcctgcctggataatgaccggctggccctgcggcgttcttgaaacgttcagaggtccgcgaaccgagaaatattctcctttgtggttcagctcgtgcattttttctttgtcaaagaattcacccgtttctttattacggataaaggcgtcctcttcccatgaatcccaaagcccctttacaacttcgacaaattcctctgcccgctgataacgcaaatggtgttcaaggtgcttttcaccgctgaaattcagcgctgttgattcaatagatgaagtgacgacgttccatccggcacggccgttggacagatgatccaatgacgcaaactgtctggcaatatggaatggctcgctgtatgtagtggaggctgttgctgtcagtccgatttttgatgtgacctgcgccaaagcagagagcagggtgaatggctcaaaccttgttaatacatttggatgtgatttgctgtcaattgaaaggctgtccgctaaaaacagcatatccagcttgccccgctccgctgttttcgcaagctctttaaaataatccaaattcatgctcgcatctgagggcgcgtccgggtgccgccaagacgcaacatgatgacctgtacctgctaaaaatacccctaatttgatttgtttctttttgcttgtcatgacgatactccttttatcatgtttttaggctgaataatccgaaaaataaactcctatattcctagtcgtttaatatgaataaatcaaaatgtacctttgtcttggacgtttgtcaatgagttaagattaattttttctattcaagcgaaaagacccttgcgtgaccatgagggaacggcattgattcattcaactagtgcaacctctatatcggcaagaaaactgagtctaatgaagcaaagactcagttttcacccaagaattttatataagatttcgccatttcctttgccttttcttcgcttttgcaaaccgcctatccattcagacgccgtaacgattgtataaaaaaacagctgactccagatattcaaacgggaatcagctgattgatgtgaattaattaagctcatgaatactttcttctgctttagcagaaaactctttaggctcaaggcggtctaggtcttcatgaaataaactcactttttggatttgccgattgtcatagtggtggaaatagtagtttccagtttcgttgcacatcacggaagtatattgcgtataatgaatttcgtcttcttccgttatcactgcgccctttggtatcgtcatatttgccaaaatttgaaaagcggctgttacacctttcgtttcatcggccgccggctctagatgttctttcaaataaacagctctgacaaaccgggaaggcggtgtataatcccccggcagaccaacagttcctaagccttggccaaaagcagaaagggctaatccgcccatctctttgctctctaattgcttcggtctgattcctgtatattgctgcagattggttacatgccatataaagtcggggctgttcgtcatgacaccaggttgattatcatagactttgaggccgtctgctcttggttctatcgtcaggcttcggcccgtccggtctgacaatatccagtgaagcggtaaaactgtatccaatagatctaattttttctctacaatcgttaaagatcgaatcttttcttttacgtcttccaaagactgacagactgacagcacccatgtcacaaactcatgcgggacaatgtgaacggtatcttcccgtatcgttttttcgtactccgcatagcccggaaaataaagcgccgcacaagataaaccgctttcattaacgccgtcggcaaataatatatttccaagttttctccccataccgataaacgcgtactgtgtctgatgggcctttccgtcagcttcactcttccagctgtaacggcgcggatagagaatgacctccgtccccagctgaaatgcaaaatccattgttctcgctaataaatgattccggtcagcagtttccaatgtaagacttgtgcacatttgatcagtccccttttcaattcagattaatatcatacatattgtgaacgaattggttttatcagcataacgaaagtcaaatcgattcgtcaaagaattgacattacatcaaataaaacgaaaaaatccagccttctaagaggctggattttttattatttagccaaaacaagctcgtgaatcgcatgtgcaacgccatgttcattattggagcgcgtttgaaagtttgcggcttccaatacttctgggatggcgtttgccatggcaaccccgcagcccgcccattcgatcattgtcaggtcgttcccgttgtcgcctatgcacatgacttccgcctgttcaattccaagcagctgtgccagctggcgtacagcatttcctttgctggcttccgagtgcagaatttcataaaagaaaggcgcacttctgaccattgtatatttttctctcacttctttcggaatcgatgtaatgacgcggcttaagttctccggtttatcaataaacatcactttcgggatgaggatatcttttggcacctcgtcaattttgcggaaatgaagcggcacctgtgtcacataggattcgtatacggtaaattcgctaatgtcccggttaggcgtatacaaattagatgagtcaaagaaatgcatcggcgtcttcagctctaagctcaggtcatataatgaagccaaatcatcataaccgagagacagctctgagaccacttcatttgtatgcgtattttgaacaagtgctccattatacgcaataacatagtcgccttcttcaattaaattcagttcatctaaatatctctgcacacccccgataggccggccggtgcaaagcacaattttgacaccttccgcttttgccgcgtgaagggcgtcgcggacctcctctgttacttcatgatgatcatttaaaagtgttccatccatatcaattgcaattagtttgtacatcctgcatctccttcatgtcgttttcaggctatagtcccatcatatcgttttttctttttgatattcaaccggaagagatggttttctccggattctgtttagacgccgcccttgtcttcggatacgcaagcgcggtttccgctttctttctgccttgacgccgttttctgcttttttctgtttcatcagcagaaagccggcagctagaaaaggaatgccggttatattcaagatggcaagcttcacacccgccgcgatgaaaaagaacccccatgaagatgatggattccgtctgatcatgacgtaagccgccatttccagaacgatcaggatggcatgaagcactatgccataaatcagcaatacaagggcaaaaaacaaaacataattcacgattgcccctgagtacatcatagcgcgcatcatttgtataaacgataaggactgcatggagccgctgatgacattagggttatagatcgtatagtcactaaataaatgtttgactttgagaaaagcccataatataaatatccattgaatgatatgtaaaacaagccccgctgccaccagtctttcagctttttgatttctcatctttctcctccctgccggtctttgattcgattcttgtcatcgtttttctctgtccattttgctcccatatcaatgtcccgttttctcctcttttcagcgtgcttttgagcggataataggggccgaggtactgaatctcgatagacccgtcagtgctttgggaaatcaccttgtatgccataaaaggcagctgtacctctcctcttccttcaatcacttccgtttccacaacctcgtcttcggtaaatgtgactgttgctgatttcacaccgtccgttggcccgggggcacgcccctcatcccacgttccgtaataaaacggcgtctcttctttttgctgctggcagcccgataccatgatgcatacagcaattaaaaacaaaatgccatatttgtttctcaaggggatcaccattctttcctccttttttgggcgaatgccgtgccactgtgccaatgactacataagttataaggaattcacccacaaggagactgatcacatgaacccttatcaatattacagccctcagctgcctcagcaggaaccttactatagccactatgagtacaatccttatccgcagcaggatgtatacgatccataccaaatggacagacagccggcattggaaagaagaatcgcagcacttgaacggcaaaatgaacagcagtcaagagaattaacccgtctgacaaacgaagaccgccgtcaaaatcgggaaattgcacggattgccgaacaggtcaatcagttaagccaggctgttgaacgccatacacgccgcctaaatcggctcaatcagcgcctccgtacagtagaaaaccggctgaatatcccatttactgcaggggaaggcggtttctgagcgaaacaaagaaaaaaagcggaatacgattctcccatctcagggtttcgttttccgcatttcttatatgttaaaacggaacatttacataaaaagggtttgtacccagtatacaatctttaccgttttcattcaaagatagaggggctgaggaaaataattgtagttcctctttgacggaatttcttttcattcaagttgcatgataataccgactcacgtcaatcgatacatggagggatcattcatgcataatacacaacacggcttgcagcagctgaaccaatgccgccaaactgctcagcagctcattcagcaaacacagcaaagcagccagcaatatcgccaaatgcttcatcaggaacagcaaaacatccaaatgctgcagcagattctaaaccacgaacaacaagctgcacataccattcagcaagcactgcacgggcatgatatggcgattcaaaagtgccagcaggttgtcaacatgtgcaaccaaatgcaacaggaacttactggacaatccagcgtcatgaatacgaatgtgtctacacttccattcggccaaaacacgccatttcagcagcaatcctatcagcagtaacatataaaaagctcaacacaatgcgagtgttgagctttttttcttactgttctttgcgaatatgtatatcctgaatagactgtttcggtgcatgaaatctgctctcggcttcacttcttgcctcggcaaaagcccgcgcctccacatgatctttgtagacatccagctgaatcaaatacagcgggcgcactttaaatccatgaataatggtcaccgcccataacgggaccacaataaaaacaccgggcagatcgggcaaaacaaaaccaaacgcaaaaatgaaaaaataaatgatgccgtacatgatccactttctatttctaaccttgatgccaataaataaaaaggcaaaaaaactggtaatggcaaaaggcatgaaaataaacagcatccaccagctatgcagccattcccaagcggaacctctttttgtaattcccatatttttctcctcctatttacctataataatcgattaggcataccgcgtcacccataaacgggaaaaactttctcccttaaaaatagtgatagacggggaacaggtttcttgctatattattaattgataatgataatcattactaatctattgagatacatagtgggagggttcttgatgaaaaagaacatattgctcgtgggcatgcttgtgctgcttctcatgtttgtcagcgcttgcagcggcacggcttctaaagggagctcaagcgattctgcttccgaaaaaacagaagtgagaacatacaaatcaccaaaagggaacgtcaacattcctgcacatccgaaacgcatcgtcactgatttttatgccggtgaattgctgtctgtcggggccaatgtggtcggctcaggctcatggtcatttgataatccgtttttaaaatcaaagctgaaaaatgtgaaggatgttggtgatccaataagcgttgaaaaagtgatggagcttcagcctgacttaattgttgtcatgaatgaagagaatgttgataaattaaagaaaatcgctccgactgttgtcataccttataacacagcgaaaaacgtagaagatacagtcagcatgttcggagatatcgccggatcgaaagacaaagcaaaatcctttatggctgactttaacaaaaaagcggaagcagctaaaaagaaaattgccggcgtcattgacaaagatgcgaccttcggcatttatgaaaacacagacaagggcgaattctgggtgttcaatgacaatggcggacgcggcggccaagctgtatacaatgcacttgggttaaaagcgcctgaaaaaattgagcaagatgtcatcaaaaatggagagatgaaacagctctctcaagaggttattcctgagtatgccgcagattatatgttcattacggattacaacccgaaaggcgaaagcaaaacactcgacaagctggagaattcctctatttggaaaaaccttgatgctgttaaacataatcgcgtgtttatcaatgactttgacacgttctacccgtacgacccgatttctgtcagcaaacaggtggatatcatcaccgacatgctgatcaaacgggccgaagaaaataaaaaataaaaaaacggcacagtcatgacgctgtgccgttttttatgattcactttaattttgattgtacggagtccggcatatcttcaaacttgacttcttcccaagtctcgacatactttcctttcgccttcaccttcaaatacgcgttcttccgaagctctttgccggcgaaaaaggtcacttcttctttttttccggatgcattatatccgtctaatgtatattcagtaccgcccggactaagatgtctgccatctcgatcaatctgaacatagacatcttgctggtgaataaacggattaaatctgtctgtaacatcgttatgaaaaaagagaagcccgcatattacggcagcagccgccaagacggccaggattgccattgcttttttcatctttgcactccccttacttgttcatttttttcaaatagcttgaccgcaccgcgaggaagaatagaagctgaaaaatgaaaaaccctccgatggtgagactgagcggccccgcgacatcagaatagccttccacagccaatgttctcaaggcaaacagtgtatgcatgacggcaatgacaaatggaaagaagaaaagaatggccaattgtattgtcacgctttgtgccatttctcgctcactcagaccgattttggccagtgaacggtagcgctcccggtcttcatctaaatcagtgaacagcctgaaatataagaaacttgctgccgcgacaaagaatacaattgcgataaacaggccgataaataaactcaggctcggcagctgcaccgtatcatagtaagtcccggcttttgaagcaaaatcagaatgcacgtcgatataattgccgtaaatctcattttgcaaggattggctgatctcaagactgtctttccaatgatcatagctgtagccgtataatgacgcttgatcaccgagtgatttcagctgatcaaaggtttgatcattcaccgcgatgatagcattcaatgagatcagcggttttttgacttcttttaccgacagtttttgatcagacagctcccctttttggttcagcagcttcagctgatccggcgcttcgtttttgaaattgcggtcatacgttcccgggaaatagacagcctcgtcttctttcaggccgttcactttgacatggaagtattttgccgcatccgattcactgatcatgtaaacagggggaacagtttctccttcctgatagcgaacataggaaacatctattttgtctttcttatacgtaaagccgtgtgttttcagttcatggtcaatatctttcaaatgagtctgttcttttggattgttgctgtaagataaatactccatttcataagcggactcttccgctccgacggtcgatttgtacattgcgagcacgcctgtcgcagtaaacgcaaccgcggaaataatgctgacaataaagaacaggcgggcgttgtcttttagacgatagacaaggtcagaaacccaaatgatgtttttcccgcgcagataaaaggttttccacttcttcagcgcgcgcagaatccatatgctgctttggctgaaaaagaaatatgttccgataacggtgagcagtaaaatgataaacggttcggccccgtggacattgcctttaagaaccatgccgtacccgccgcacagacaggcgatgccgaataaggacagaagcacggacggcttaggctccggtttaaccttgccagtgccctttattaatttgataaccgtatttgatctgacaaaaaggatcgtaaactgcgataaaaagaaaaataagagcagaaatccgcaggccgtaataccgagcgctttccaaggcatatacaaaggcagcgcgtccatttctaaaatataagcgccgaccgtaaagaacgtctttgaaaaaatgaatccaccgattatgccggctgcaattgacatgacgccgatgatcatattttccgcagtaatgagctttctcagctgccccggcgtgatgccctgcatgagcagaatgccgaattctttatttctcgatttcaaaaatgcattaaccgaatacagaacaaataagaaagaaaaaacaaagatcatccattccgcggcggttaagccttttttggcgatgttattcaggtagccttcctttaatgccggatgaaacaggaacatcgcaaaggtaaagaaaatcaaaacggaaaaggcgctgcttaaaaagaatgcaagataagcccttttgtttctcgtgacgtttttataagcgaactgaagaaaggtcatttgcgtttccccccagcatagacagcacatcaagaatttgttcataaaagacttggcggttttccccgcggtaaatctcattaaacaattcgccgtcttttataaagatgacgcggcggcagtagcttgccgaaaccggatcgtgggtcaccatcaaagccgtgacatgatcatcccgattcaggctctgcaacgtttccatgacgtcttttgtcgctttggaatcaaggtttccagttggttcatcggccagaatgagtgacggcttatgaatgaccgctcttgcgatggcggcccgctggcgctggcctccggatacttcaaacgtccgcttgttaagcaggttttcgataccgagctttgccgcgatgccgtgcagtttttcttccatgacagacggcgcttctttttcaagcgttaacggcagcatgatattttcaccgatcgtcagcgtgtctagaaggttgaaatcctgaaacacaaatccgagctgcttgcggcggaaatgagcgagctttgtccgcttcaggcgatgcgggttttctccgttaatcaggatatcgcctgaatctggacggtcaatcgttgaaatgatattcaaaagcgttgtttttccggacccggacggccccatcaccgccgtgaactcgccttcttctattgaaaatgaaatttgctttaaggcctgataggacacttgtcctttataggttttatttatatgtttgacttcaagcatattcgccatgaaaatcctccttatggttttattcttgttgatctgggctgctttcatgtagtgccgggacgttcaacataaaaatccccttgacataaatccatgttatcaaggggaaacaaagcgggctatgttgttttcttaacgcagccttacatttttgtaagaaatgaaaatcgaactgatgtcccttcaccgggagacgagctgatgtccaccgtatgattgagcttatctgtaatttctttgacgagatggaggccgattcccgtagattcttggaaacgccgcccgttttcacccgtgtaataagggtcaaacacccgcttgatgtcttgtgagggaatcccgacaccgtaatctttgacttcaagcaccgtcctgtcttcatcgcggaagacattcagctcaagtctgtcactcttgcccgctgaatacttgaccgcatttgtgaccacttggccgatcgcaaatttgagccatttggcatcggtgtaaatctgatgatcatcgcaaacgttcattttcggataaacgcgatattgaataaaaaatcgtttatagctttgaatgactgattggagaagctcggacagggaaaccgcttcgattttaaaatcccgttcaaacaggtcgagccttgaagaataaagaagcgtctccagcccgaattcaatctgccggacttcttttttgatttgttcaaaaacgggctcatcctcttcttgaatgattaaattaatgaccgacagcggcgtcttcacttggtgcacccattgattcatatacgtcacccgcgcgtcaagcttggcttcggtctcatggagcttctggtgctgcagccggatcagctccatctgcttttcatacagctctgaacagaacactgaagaaccgagatacgggatatccgtcccttcctgccccgagctgagccaatgatacacgccgcggtctttgtaccagcgataggcaagatagcccgccaaaataagaagctgcacgcccaatatgtaaaacaagtgagaaaaagaatgcagacccgcaaaccagtaataaaagaagacaaacagcccttgaaggagaaaaagcagaatcagcactgcatgagaccggagaaacagcttcatgactgcgccctcagctggtagccttcgccccgcaccgcttcaatagaaacaggcgcattcagctcccgcagtttttttctgagccgcgtgatatacacgttaagtgtattatcatcgatgaatatgtcggtgtcccacgtcttttccatgagacggtcccgactcgtcaccttttctccccgctcaagcagcacttccaaaagcttgctttcttttttagaaagctcgcttttttcatcctgaaaacgcagttcaaaccgttccacaaagagctgaacgccggcatattcaaccactttctctccctgctttgcggcgtactccccgtacgccctccggatctggcttttgattttcgcaagcacaatatcataagaaaacggtttttcgatataatcgtctcccccattttcaatcgccatcacctgatccatttccccgcttctggcagaaataaagatgatcgggcttgtggagtgctggcggatctgccggcaccaataatatccgtcatatgccggcaaattgatatcaagcagcaccacatcgggcttttcccgcaaaaagacatcaagaacagctgtaaaatccgcggcgaccactgtttgatatccgtatttttcaaggtaattctgcaatagtccgcgaatgtcttcactgtcttccacaatcataattttattcaaactgaaccactcccgtttcttacactgctgccatcatcataatcgttttgggcgtatggacgcaacaccgcacaaaaaaaccgccatctcggcggtttctgatctctttagccgacctgctgcttagctgctttaccggctgatccgaactctctcattttgcttcgcactgtctcttccacggcttcaatgccgggtgtcaaatagccgcgcggttcgtacagatcgctgttttcctgaaacatgcggcgtgtttcgtctgtccacgctaccatacattccgtattgatattgatcttcgcgtggccgagtgtgatggcttttttgatctgatcctgcggaatcccggatgccccatgaagaacgaggggaatatcagtcatgcgagagatagcctccatttccttaaatccgagattcggctcaccctgatatttgccgtgtacagagccgagggcggcggccagcgcgtcgatattggtttctttgacgatccgctcacattccgcgatatcggcatagcggaccccgccgaccaggccgtcttccattccaccgaccgtgccgacttcggcttctactgacacgccgtgttttgcggcataatcggtgacttcttttgtcatcgcgatattctcgtcaatcggctgatgggagccgtcaatcatcactgagctgaatccggcatcaatggcctgtctacagcgttccgcactgctgccgtgatcgagatgaagcacgaccggaacggtaatcgccatgtcctccattaacgcgccgaccatggcggcaatcgttttaaatccgcctaaatagtcgaccaggcgatcggaagccgcggcgatgaccggtgattgctccttttgcgccgcctgcaaaatcgccttcgtccactgcaggccgttgatattaaactggccgatcgcatactgctcccgctttgcatcttcaagaagctctttcatcgatacaaaagccatgtccacccctcctttatccattacatgttgaagtattttgatacgacgtccactgttgtttttttcgctgtttgaatggcttcctcagcagtcagcttatagtattcaggccggaatagctcaaccgatacaacatcagagaagccgatttccttcagtgctgataagtgggcatctaagtcaattgccccttgtcccggccatacacgatcctcatctgttaaaaagccgattgggaaatcttctgtatcatcgatatgatagatgaagattttctttccgtccgcctgctttaagctctcaatatttgaacccattgcatggaagtgaaaactatcaaggacaagcccgacattgtcacggttaactgtgtttacgatctcatacgcctgttcaaacgtattgaccgtacattgcggatggccgacaaattcaagcgcgatttttacgccgtacggctccgcgatatctgacagctcagtcagcacctctacactgctctttttgatctcttcttttacaatcttctgctctgtcacaagcggaacggccaccacatatttcacaccgagggttttgcatgtttccatcatgcctttaaattcagtgatgatctcgttgtggcccttttcatcacggttgttgaagaaaacaagcgcgtttagggcaagcggtttgatgtgatgggtttgaaaatattccgcaagatctgccaatgaatgatcttttaagtactcgggcagcttatccattgtgcggatttcaatataatcatagccgtgcttttcgcatagttctaaatcctgtttaaggtttgagttttccaatgttgtcgcttcattaaaacaaagtttcatgccagactcccccatctgcgttttagatatgaagggagttcggcaggaaggctgtcgccatatcccgccgaactccatgctcagcttatgccagacctaattcttctttcattttcttaagcataaatcggcttgattcatccgctctttcatcgacccaagcaaatacggcattcgtcgcaattccgtcgaacttcatctctctcagttttctgaaaatcgtatcaaaatcaacctcgccttggccaatgtccaaatgctggtgaaccgttactttcgcgtcaggcggattgacgatgtagcgaaggccatgagccgctttatgattataggtatctgcaaataaaacatgtgtgaggcggtcgccggcttcgtcaaacatggtctcgatgtcgcctttgccgtcatcatagaagaacgtatgcgcagtcgagtagacaagattgatccaatccttgtcaagcgcgcggatcatatccatcgcacctttgtgcgtttcgataaaatcgtatgggtgggcttgaagattaagtttaataccttctttttcaaagactggcagaagctcatccatggatttgataaatttttcttcacttgttaaaggatcatattttgaaccgctgaattcgctgttcatcaaatccacttcaagttcaaccgcaatttcgattgcccgtttccaattgcgcaccgctgcctgccggcggtcttcatcaggacccgcccagtggtaaagaggaagaagcgatgaaagcttaacacctgtatctcttaaaaggcgctttaattgtttgatctttgctgaatcaactttcggatatttataaaacggacaaaaatcctcacgcggagacaattcgatatattcatagccaagctccgccgttttatagaccgtttcctctaaagttaaatcatcacgatacatggatggatccaatgctaacttcatattttcactcctctgttttttagttttgaactgttgtaaaagattgatagaattccggtttttccttcaattcaaccttttctttttgtccagattcctgggcttttacacacgcgtcagtcgtgacagcagcaatatagccgtcccatgccgtcggtccgctgacctcgcctttcttttgaatcgaatcaataaagtcttggatttccacatcatacgcagcgacaaagcgtctctgccaatccatcaaaatatcagtactgaatctgccttcttttctcaagctgatgcttgatggctcgggaagcttgatgatgccgtcttctccgacgatttcgcattgaatgtcatagccgtatttacagttcacatagatttcagcattgatgacgataccgccttttgtttcaattacgacgatttgcggatcttttaaatgcggcagcgcgtttttcgattttttcgggtagatgacttgaacggactcgtagtcatcgttgacgagccagtgcagcacatcaatttcatgaacaagcgtgtcgactacggccatatcggttgtgtagttatctcctacagtcgggttgcggtgcgcgcagtgaatcataagcggttcgccaatcacatggttatcgagtgcttccttcagctgtacgtaaccgctatcataacggcgcatgaagccgacttgaacaaggcgtttgcccactttgatttcttcttcgacgattcgcatgcatccttcagccgttgtcgcgagcggtttttcacagaacacatatttctgggctttaatggctttcagcacgcttgactcatgcgcaggcccccagcttgtcactaaaacagcgtctacattttcgtctgcaagcaagctgtcatcattcggataaaccgtcgcgtttaattggtattgctcaacgaccttttgtgcagcttcttgattaacatccgttacagctacaatttccgcgccggacagcttgttcgtgatgcggttaatatgttcttttccgattgctccagttccaattacgccaatacgtaaactcattgacagccactccttctgttgattacataattttgctttctgtttcttgctttacttggctctgaggagatccgtagagttcctcttgaatttgttcaagcgacttgccagacgtattcggcgcaaagagcagcccgatgatcatactggccgtcacacatccgagaagaattgcagccatcgttccaatgccgaaattggtgataatcattgggacaaacagactccaaatccctattgaaatacggacaaggaaaaacatcagcccttgtgcggaagcacgatattgcgtaggaaagatttcactggcccataactgatagttcgcttgctgccctgctccgttattgatgccgatcacgacaataaacaggagcagaatcggcaggccttcaattggcagcagaaacagtgtccacccgatcaccgccatgaaagcggcgattccaaatacggtttttctatatttgtcggcaaagggcatgaagatcaaggcgacccccaatcctgtgaagataaacagccccatttgcaaaaggttggccatgttggcagatacaccgccgacctgctgataaatgtatggcataaagaagcccatgaccccggcagctaagttccaaaccaagtacacacccatcaaaaacaatatgctttttagatacataggcttgagcaaatcaaaatacgatgtcttattcagtacagccggcttctctgcctgagcatcctccggctgattttttgtctgccaggcgtctgattccggaagcctgattctcaggatgtacgtaatcagcgcaatcacaagcagatgggcaaatacgattttattccccaagagtcccaagtcaccggccagtacggagagaagcagtacaacgacagcgcccgcggcccaagcgacttgtgctacgccgcaatgcctggcccgattcttctttggcgcattttccgcaataatggtccatgacgcggttatatcagctcctactgataaaccgataatgatgtaaccgcttaacaacatggggaaattaaccccgaacaaaaccaaacaaatccctagtgcataaaccagcatactattggtataaacagccttccgtccgactttatcagccagaaacccgccaagcagcgcgccgacagcggcagaaatcgcattcgcgctcagcgcgccgagcagcccgatttgcgtatcggatagcttaaggtaactgacccataatgataaaccggcggagcctgccacaattgaaccggcatcaatatagttggccaatgctgccgcgattgtccgtttattgaaggctgaatctccattggtattgcccatatgttcattccccattaagccagatccaacaactgctgatcaatatagtttctcgcaatcaatgcatactccagcgggtttgcaacatcggggtcctgttcagcttcaatgacaatccatccggaataactgtgcttcaacagcagctgatatacttctctaaagtcaatgcagccgtcaccgggaaccgtaaacatgccttttaaaaatgattgccggaacgattgtccttcgagcctgcattgttccatgacattcaggcgggcatccttaaagtgcacatgcttaatgcggccgatatgcttctcaagcatccccatgtaatcgccgtcagaaatatacgcatggcctgtatcatagaggaggtgtacatgcgcagggtctgttcctgccatcaggcggtccacttcttccgctgtttggacaccagtgccgagatgatgatgatagacaagcttcaagccatgctgagcggcaatttcgccaaggtgattcagcccttcgcaaagccgctcccattcatcatccgtaaagtgcggcttctctgtgaacacatttttctccaagccttgcacgctgtacgtttgttcagagacaactgcgacatccgcgtttacttgctgcaaatactcacaatgcagggtaaatgtctttgccgcttcaccaagtccgtcacgcaaaataaaactgctgaaccattttcctgcaatgcgtaagttccgaagcttcagctctttgttcaggacggcaggttcggggaaaaagcccccgacttccgtgccttgaaaacgtgcgacaacgatatcacttaacaaatgctgaagtgtatttcccgctccaatttcaggcatgtcatcattccgccacccaatgggagcgattccccacaggatttcatttttgcccatcttggtgcctcccctctaatactgcttcgcagattccagctttttctcttttgcttcgtatgccttctgaacgctttcttgttcagatacctctgccaccccgacatgccaccagctgtcatagccgtccgtcattgttttaggcagaaccttcatttcaattaatgttgatacatcctgtttcttcgcatcctctaacgccgcttttaattcttctactgtgtttgcacggtaggttttcgcgccgtatccctcagcgactttcgcgtaatcgacattcaggatttggttgtcatctgtgcggaactcgcaatagtagctgccgctgccgtgatccatttgcaggttgttgatgcatccgaatcctgagttgtcaaagagcagcacattgattttcttgttgtattgaatcgccgtgatcaattcagaatgaagcatcaggaagctgccgtctccgacgattgaatacacttctctgtcagggtgggccagtttaagaccgagtgtcccggacacttcatagcccatgcaagaatacccatactccaggtgatacgtattcggaacattagaatgccacagacgctgcaaatctcctgggagtgagcccgctgaacagatgatgacgctgtcttcaggaatcgtctcgttgattgtcagcaatgccgttgtttgcggaagctccgtattcaacgcgtcagcatattcattcaggacctcttgagaaaaatgatttttgatttccggatcaaatgcttcccgcttaaacgtcactttgctgagacgctcgcgttcagctagccattcgtccttcagctcccgaatcgttgtgccgaactcgctctcatagccttcaagcaagccatgcagtttgccaagcgtcgctttcgcatccgctaccacttggaatgcatcaagtttatacgcctgcattcggctgacgttaatgttcaaaaacttcgctttatcaaaatcaaaagcggtcttagaggatgtcgcaaaatctgtataccttgtgccgatgccgataatcaaatcagcttggcgggccgctttgtttgccgcaagtgtacctgtgatgcccattccgccaaggttgttcgcaaaatctgcctcaacagtagactttcctgcctgcgtttcaactaacggaatgttataggcttcagaaatggcaaccaattcatcgcgcgcaccggaatattttgcgcctccgccgacgagaatcacaggttttttgctggatttaatcagctccgccgcaccttgaagctcgcgctcgctcggctgcatgcgatcaatatagtgaacccgtttgacgaagaaactttcatcaaaatcgtatgcttccccttcaacatcctgagaaatacaaatcgttgccggacctgcttttgccggatcagtcatgacttcaaacgcgcgcagcaaactgctcatcagctgctcagggcgcgtaatgcggtcccagtatctcgatacaggcttcaatgcatcgtttgtcgtaatcgccgcactgtattcttgctccatttgctgcagtacagggtctggctgtcttgtcgcaaatgtgtctgccggaatcaagagaactgggatattgtttgccaatgcagtgccggctgccgccaccaagttagccgctccaggtccgacggatgtagacaccgcatatatttttcttctcagcatttgcttgctgtacgccatggccgcatgcgccattccttgttcatttttcccttgatagactttcaaatggcctgcatcctgctcaagcgcctgcccgatccctaatacgtttccatgaccgaaaatcgtgaagatcccttcgacaaaaggctcttcctttccatctacatggatgtactgctggtttaagaatttaatcagcgcctgtgctgttgttaagcgaattttcttgcccacaaacgatcccacctttactcgatctttttcaattatgactgtgcttcaataagctgtacgatttcatcagcagtcggcatcgcttctgacgaactgtgcttgctcaccacaatggaagctgaagcactgccgtatttcaatgccgtttcgatgtcttttccggtgacaaggccatagataaaggctgacgcataggagtcaccggctccaaaagttttcagcacttttgtcttgtacgcttgagcgcggaatacctcgccggatttgctgtatgcgtaagagccttcgacgccgtgtttgatgacaacgaggtcggctgaatggccaaataaatgattgacggattcttcattgcttccgcctgtgcggttttccatcacatcaaattcatcgcgtgtgccgatgacgatatcagactgctcggcaaccaaagaataataaacggctgtttcatctgatgactgccacgtatacgggcggtaatccagttcgaacaccactttaacctgatgcttcttcgcgtattgaacagcttttaataccgcttcccgtgacgggcttttggcgagcgctgtcccggaaacaagcagcattttcgcatttgcgatatagtcttcgcttacctctgaaggctcaagataaagatccgccacatcatcgcgatacattaaaatgctgcattcttcagggctgaggatttctgtaaatgcaaggcctgctttgtgtccatcttgatcaacaaccatctgtgttgtatcaacgccggtctttctcatataggactctatgaatcttccatgctggtcatccggaattttgccgatgaagcccgcttttaagccaagcttcgcgctgccgatcgcgatattcgcaggtgaaccgccgacatatttcgaaaatgtcatcgtttcttccattgggcggttgtattcgactgcgttcagatcaatacatgcccggccgatggcaacaatatcaaaagccttctcttcattgaatgtatacttcatcgtaaacagccactcctcacttgttagcgttctaaaatccattcatgcgccgggtcgttataaaacttccattttcgcgtcggccctgccatgacatttaaatagtaggatgtgtatccgtccggaacgcctaccgggtggtatcccgcaggaacgatgacaacgttttcatttcccacagtcattgtctcgtcaatagaacggtcatctgtgtatacgcgctgaaacacaaagccctgtcccgggtctaactcatggtagtacgtttcttctaagaaagattcttccggcaagttgtcttgatcatgtttgtgaggcgggtagctggaccagttgccgctgtctgtatagacttcaactactaatagactgttagctgaagggtctgaatccggaagaatgttatgaacagtacgtttgtttgaaaattgcccgcgatgctcaattccgttgtcttccgctttgatcagctttgtcggaagctgcttttccgatggagaatagcaaagcgccactcttgcgtcgctgactgctgtgatctcaaatgcacggtcatttgatatatagacgctgtctgtcggttttcgttcaaatacgctttcacgcgtgccgatattctcaaaagtcgactcatgatctgtcactgtaatttttcccgttaccgccacaatacagatttcttgttttttcaattcttctgtatagcttgaacctgatgcaagatctaacactttaaactctacataagtgagatcagagttggatgtcgttacttcgtgcacgagtttgaccccattagacacttcatgcgactgcggcttacgcaacaaataactcatagagaagccctcctctttctattggcagaatgagtccgaacagcgcacatggacgccgttcggctgttcgtcgtttagttgaaatcaggtgccggatatcttgccgtcaccacttttttacgtgtatagaagtcgacgctgtcttttccgttcgcatgcagcgttccaaagaatgaagatttccagcctgagaatgggaagaacgccattggagccggcacaccaaggttgatgcctagcattcccgcatcaatgttttcacggaagtagcggattgcgtttgagttggatgtgaacaagcaggcgccgttcgcaaactcagacttattggcgatttcaatcgcttctttcaggtttttcacacggatgacagataagaccggagcgaaaatttcatctttccagatcgtcatttctgttgtgacattgtcaaagatcgtcgggccgacaaagtagccgtcgtcagacacattttcacgtccgtcacatacgagtctggcaccttcttcaagacctttttcgatatagctgagcgtgcgcttcttgttgtcttcgcgaatcaccggtcctaagaacacgccgtcatcaaggccgttaccgattttaatgtccgccactttttcctgcagcttcgccataaattcatcggcgattccttcttcaactgtcacaaccgcacaagccatgcagcgttcaccggcagaaccgaaggcagctccaacgatgtttgtaaccgtgtcttcaagattcgcatcgttcaagacaatcgtatggtttttcgcgccagtcagagattgaacgcgttttaagttttcgcttccttttttgtagacgtattcgcctactggcttggagcctacaaatgaaatcgctttaatttcgggatgctcgaggatgccgttcacaacgtcatgcgcaccgtatacgacgttgaacacccctttcggaaggcccgctttttcaaaaagctcaaccaatttctctgttaacagcggagtccgctcagatggctttaaaataaatgtgttgccgagcgcgatcgccatcgggaacatccagcaaggaaccatcatcgggaagttgaatggcgcgattccgccgacaactccgattgggtaacggtagttcgccgcttcaacgtccgttgcgatggaagcaagtgagtcacccatcatcagggaaggtgctccagcggcgaactctacgttttcaatcccgcgtcccacttcacctaaagcttctttcgtgttttttccgttttcaatggtaattagatgagcaagttcttctttatgctgagacagcagctgctggaagttaaatagaattctggcgcggcgaggaaccgccacctttgaccatgttttaaatgcttcagccgctgtttgcgctgcgtaatcaatatcctcttttgtagaaatcggcacttggcatagcacttctttcgtcgccggattgacgacatcttcatattgatctgttttgctttcaacccattcaccgttgatgtagttttttaattttctgatttctgccattcttattgcctccttcattagtaaacacatacacttgtatggatggttccggatagattcatatcaatatccacttttcagcaagccaagaattaaacgctttcaaaaacaccaaaaaaataaatggcggatgcatatttacatacaagcaaccatttcatgcacaacaggttactttttggtcatttcttggttatattctaatcgcataatacccataagtcaatcataaacactacattttttcattatttttattatattaatcttttaatcaagtaagagaagtaagagaaggccgtccaatcttgcaaaagatatacaccgatgttatcattttttaagcaactattgattaacttttggtttttattatatatttatgttacgtaaagattcaagaaggagttttttatatgaaactgatgcggattcaggaaatggaggagtacattttatcgcatggcactgtttccttagatgagctgtgccaggtgttcaatgtctccaaaaacacagtcagacgtgatatcaacaagctaacagaaaagggtgcgattgaaaaagtatacggcggcgtaacatctattgaaaaaaccgcattagttccttttgaaaatcgcaccattcagcaccaggatgaaaaaacaaaaatcgcccattatgcttcccgatttattgaagatcacgatttggtcttcattgattcaggaacgacgacaaagtctattcttgatacgcttgatccagccaaaaatgtcaccatcttaaccaacagtttagacattatcaatgcggcgtcagctttgaagaatatcaacttaatcattatcggaaacaactataagagaaaaacccgctcctttgtcggcatggacgacccggctatgcttgataagtacaatatcaacaaagcctttatgtccgctaccggaacgacgctgactcacggattgaccaattcggatctgctggagtatgaaattaaaaagaggatttcagaaaaagcaaaagaagtgtatctattggctgaccattctaaattcggaaaatcaacgcttctgacgtatgcaccgtttgacaggctgcattgcattgtgacctctcagccattagacgacgagtacacgcagtactgcaatgagcatcaaatcggcattcatctggcctaacgtttacaatagtgttgagagtctatcatccattttattctaggaggcagatcatgaaaaaagcgaagctcggaaaatcagacttgcaggtattccctatcggattaggaacaaatgctgtcggaggacataacctctacccgaacctaaatgaagaaaccggaaaagaattggtgcgcgaggcgatccgtaatggcgtgacaatgttagacaccgcttatatttacgggatcggccgttccgaagaattaattggtgaagtgctgcgtgaattcaaccgtgaagatgttgtcatcgctacaaaagccgctcacagaaaacaaggcaatgactttgtctttgataattcaccagaatttcttaaaaaatcagttgatgaaagcctgaagcgcttgaataccgattatatcgatttgttctacattcacttccctgacgaacatacgcctaaggatgaagccgttaacgcgctgaatgagatgaagaaagccggaaaaatccgctccatcggtgtatccaacttctctttagagcaattgaaagaagcaaacaaagacggtttggtagatgtattgcaaggcgaatacaacctgttaaaccgtgaagcggaaaaaacattcttcccgtatacgaaggagcataatatttcatttatcccttacttcccgctcgtatcaggtttattggcaggaaagtatacagaagatacaacgttcccagaaggcgacctgcgaaacgaacaggaacacttcaagggcgagcgtttcaaagaaaatatcagaaaggtcaacaagcttgcgccgattgccgaaaaacacaacgtggatatccctcacatcgtattggcctggtatttagcaagaccggaaattgatattttaatcccgggagcaaaacgtgccgatcagctgattgataacatcaaaacagccgacgtgacgctttctcaagaggatatttcatttattgataagctgttcgcataagaagaaaacagccttctccattggagaaggctgtttttttgtgcgataaattcctaaataactgattttgaagcaaaaccttacaaaatgagccataaatccgataaaataaaggtagtttatctcagaaagaaagtgattgagaaagcaaaagtatgaaacgttcatatcatctagctcatatgaaataaagctgacccagcttcttttatttgctggtcagaatagcggaccatttcgatggtctatggaggaaacagaatgaaacttaaatatgtaaaagccttagttgcagtaaccgttgctttaggtgtactgctgccatcaacgatttctcatgcaaagagctttagcggccgctcatcatctagttacagcagccgaagttcaagctcgtcatacagcggaagctataaatcaagcccgaaatcaagctacagctcaggatcaagctcttctagcaaaaaatccaagacgcctgacgattcatcatcatcgatttcgcttaaaaagaagccttcggaaaaggcaagctcatcaagctctaaaaaatcgtcaggcaccttttccggcgctacatcaaaagtaaccggaaagacatacagcggaaaaacgtctaaagcctatgttggcggacgatatgtttcagtcaatcattactatcacgcaggtttcgcgccatcaggatggtttggatattatagcggatttacaatgggtatgttcatgatcagcatgatgcacccatggggttacacctatcatccagtcggaggcccaggttatgtttcttatggcgcttcacccattgcctggatcgttgatatcatcgctttgattattattttaatcattgtcatcgcactgattcgcgcatttaaagcaccgaagacgtacagaaggagattttaggcaatgagattaatattaaatgagcaagaaattgtagacggaatttgcgtgtatatttccaatgaagaagatatctaccctgaagacgttgaagtaaaggagctatcttataacaagcgtacagggttcttcgctgaagctacatttggcctgcaccacaagcagcttatgtcagatgacatttcagaaggcattattcagttcttagaggaataccacaacttcaatccggacgttaccgtcgttgaattgcaatttgataagaaaaaaggcttctccgccttggttttcgtcaacgaagcagaagaataaaaatgtcttaatcaaaaccttactccgcgcgggtaaggtttttttaatggtttctctgagcataaagttatttcgtttttcctaaactcagcggatctgtgatcatctcttttggctttaacgtttccgtttgttcaaaacaaatgtttcaaatgagataggaaatgggtactaatctattaactttgttatacattttagatactcattggctcaacaactgaggaggagacatttgtgaagaaagacacaaggaaatatatgatctactttttcggcgctttagggggactgctatatggttacgatacaggtgttatctccggagcactcctgtttatcaataacgatattcctttaacgacattgacagaaggattggttgtcagcatgctgctccttggcgcgattttcggttcggccttgagcggcacatgctcagaccgctggggcaggagaaaggttgtatttgtcctttccatcatttttattatcggtgcgctcgcttgcgcattttctcaaacaatcggcatgctgattgcatctagggtgatactcgggttggccgtcggcggttcaacggcacttgtgcccgtgtatctttccgaaatggcaccgacgaaaattcgcgggacactcggcacaatgaacaacttaatgattgtcaccgggattttgctcgcctatatcgttaactacctgttcacaccgtttgaagcgtggcgctggatggtcggtctggctgcagtgcctgccgtgcttctattaatcggcatcgcgttcatgccggaatcgccaagatggctcgtgaagcgcggccgtgaagaagaagcgagacgcatcatgaacatcactcatgatcccaaagacatcgaaatggaattggcagagatgaagcaaggggaagcggagaaaaaagaaacgacactcggcgtgctgaaagccaagtggattcgccctatgcttctgattggcgtcggtcttgccattttccagcaggcggtcggcattaacacggtcatctactacgcgccaaccatttttacgaaggccggtcttggcacatcagcttcggcgctcggcacaatgggaatcggcatcctcaacgtcatcatgtgtatcactgccatgatcttaattgaccgtgtcggccgcaaaaaacttctgatctggggaagtgtcggcatcacactgagccttgctgctttatcaggcgtgctcctaacgctcggactttccgcatcaacagcgtggatgacagtagtctttctaggtgtctatatcgtcttttaccaggcgacatggggtccggtagtgtgggtgctcatgcctgagctcttcccgtccaaagcacgcggagccgcgacagggttcacgactttggtgttatcggcggctaacctgatcgtgtcgcttgtctttccgctgatgctaagcgcgatgggcatcgcatgggtctttatggttttctcagtcatttgtcttctctcatttttcttcgcgttctacatggtgccggaaaccaaagggaaaagcttggaagaaattgaagcaagcctgaaaaaacggtttaaaaagaagaaaagcacccaaaaccaagtgctgaatgagcgtacattataaaaaaaggaatcgtctccttatgggacgattcctttttctgtttacaccatgaccttgcaaatattgttcgtaaattccacagggtcctgaatcggcaggccttcgatgagaagcgcctgattgtacagaaggtttgtgtacaggctcagcttctctttatcttgttcaaacgcgtcctgcagcgtttggaatacctcgtgatttgggttgatttccagcactttttccgccttcacattttggctgtcaggcatcgcgtttaagattttttccatctcaattgtcacttcgccgtcagcagcaaggcagactggatgtgatttaagccgttttgagattctgacgtttttcactttgtctgacagaatgtttttcatttcctcaaacagatccttatacttgctttcctcttcctcggactgcttttgatcctcatccgtgtctatgccaaggtctccgcttgatacggacttgaattctttttcctgataagaagccagcattttaattgcaaactcatcgatgtcctcagtaaagtagaggatttcatagcctttgtccgccaccatttccgtttgcggcagtttctcaatgcggtcgtaagaatcaccggtcgcgtaataaatgaatttctgctcctctggcattctggaaacatactcgtctaagctgaccagttttttctcttttgaagagtagaataataggagatccttcaattgatccttattcgcgccaaaatcattgtacacgccgaatttcagctgtctgccgaacgacttgtagaacgtctcgtatttctcgcggtcttttttcaacaggctttgcagctcgcttttgattttcttgctgatgtttttcgcgatcagcttcagctggcggtcatgctgcagcatttctctggaaatattcagcgatagatcctcagaatcgaccatgcccttcacaaagctgaagtggtccggtagcaggtctgcgcacttattcatgatcagcacgccattggaatacagctccaagcctttctcatattccttggaatagtagtcaaacggcatgttttcagggacgaatagaatcgcgttgtagcgaacggctccatccacactgatatgaacgtgtgtcagcggtttatcaaacccgtaatgcttttcagcatagaatttttcgtaatcctcatctgtcagctcgcttttgttttttctccagatcggcaccatgctgttgaccgtctgctcttcctgcacctcttcaaattcattttcgctgccttccttcggcttattaatggttgtatccattttgatcgggtagcgaatgaagtcggagtacttcttgatgatcgcttttaaacgatattcctctaaaaactcgtcatagctgtcatcttctgtgttctctttgattttcaggataatgtctgtaccgacagaatccttttcacacggctcaatcgtatagccgtctgcacccgcagactcccatttataagcctcttcgctgccaagcgctttactgatgactgtcacgacatcggcaaccataaatgccgcgtaaaaaccgacaccgaactgcccgataatgtcatgtccgtctttcagctcgttttcctttttaaacgcgagggaaccgctttttgcaattgttccaagatgctgttcaagctcatcctttgtcattccgatccccgtatcagagatggttaatgttctcgcatctttgtcagctgcgacctttatgtagtaactgtctttatcaaacgtaagcgcatcgtccgtaagcgctttgtaatagattttgtcaatcgcatcactcgaattggagattaactcgcgcaggaaaatttctttttgggtataaatggagttaatcatcatatccagcaagcgtttagactctgctttaaactcttttttcgccactcttgatcgctcctttaccattatgtaaacccttttcagcatctatttatcacataagatgacaattgtcaatcaggttgatagatgcatatatatgtaaatttaacattagttggatttgttttcactctttttctcactcattctcataaaaaagagaggcttcatcatcctctctttttttctgtgtcattccagcggccaaactcccgcttcatccatatatgcaccgggtagaaaaacaaaccgaacggtatcaaaaacaatagattatgccatgaagcattcagaaatgcgcttgcagtcactggaaacgtaatctcttgcaataaaaaagagatgacagtcagcacaacaaatgcagatggaatggtcacgatgcaataaaacttgagctccttcttatgctgtaccttcaaacttagaaacctcccaacaatttctaattcatcttaacatatgctggcctttcttttctcgcatgtttatcactgcacatagcgggaagacaaatagaaaaaggaggtctcgtatcatgggaagacttgaaaacaaaacagcagtgatcacaggcgccgcgacaggcattgggcaagcgacggcagaggtttttgccaatgaaggcgcgcgtgtgatcatcggagatatcaataaagatcaaatggaagaaacagttgacgcaatcagaaaaaacggaggacaggccgaatcctttcacctcgatgtgtcagatgaaaacagtgtgaaagcatttgctgatcaaatcaaggatgcatgcggaacgattgatattctgtttaataatgccggcgttgatcaggaaggcggaaaggtggacgaatatccggttgacctgtttgaccgcattatcgccgtcgacctgcgcggcacattcctttgcagcaaatatttgattccgctcatgctcgaaaatggaggctccatcatcaacacctcctccatgtcaggccgtgccgcggaccttgaccgctccggctacaacgcagcaaaaggcggcatcaccaacctgacaaaagcgatggcgatcgactacgcacggaacggcatccgcgtcaattccatttcaccgggtacgatcgaaaccccgctgattgacaaattagcaggcaccaaagaacaggaaatgggcgagaaattccgcgaagccaacaaatgggtcacgccgctcggccgcctcggccagccgaaggaaatggcgacagtggccctgttcctcgcgtcagacgacagctcatacgtcacaggagaggacatcaccgcagacggcggcatcatggcatacacatggccagggaaaatgctgattgatgagaaatggaagaaagaaacgaaataagagaggggatgtccctctctttttgtctttcaaagcaatacaaccttatactttttcacatccaaaaactgcaaaaattccctcgccagcacttcaggcggatgcgcctttccttcatccagccgatacaaaagcaacccgataatcattgcggatacataatgggcataaagctttttctctgcgtgaatatcagtttgctgatgcagataaaacgattccagcgctttgaacatatcaggtatcacatgaggaacaccccattcccgattgagaaaatggacaatgggcatatttgacaaagcagaaagcagactggcgagcgccttctccgcttcctttaaggaaaattcattcgggctggaggcaatcgtcaggtgatcaatgatctccgcacatgatcgctgtatcatggttcggagcaattcctccttattggcatagtgatcataaaaggttgcacggcggatattgcttttccgggtaatatccgaaattgtgatggctgcgtagtcttttttctccgccagcacgtccagaaatgccttctggagcgcctctctcgttcgaaccacacgcctgtcgatttgcttgtccttctctcgctctcctggcacagcttgtccaaacagccaataaaatctcttttgagaaacaagctcccataccttttggctgatagcttccggagtcgcggccgcatcctcattcagccaatacaggataatcgcgtacgtgtacaaggcccggtaatgtccgtaaatttcccgttcgatcggcgtcaaattcacatggaccggagtcagcagcacatcctgctgaaacacatccttaaaaaaacgatggaaatgccctctgttcatcatcacagaaaaaaaggatcgatgctcatgaacaaaggacagcgtcggatgcaccgtttgccgttttttgttcaaatggagggtatccatatgactgaaggcgccaaaaagcgctttgcccagcccttccttcttgtcttcgattaaatcctcaatgattgaaaacttatcctcataataaaggtagagcgatccgcggctcactttggccttttcagcgatttctttcattgtgatgtgttgaatatctctttcttccaataaagccagcagcgcctctttcacttgagcttcggcagattccggcacaaaagacacccccaatcattagacagatcttcgatatatgtacggtaacgtatagatggttcaccgttgtctttcttacagaaaaggtaccaccttataataggtccgagaaaagaagaaagcaaatgagggggattttacaatggaacagcaagtaaaggacgacatccagcgtgtctttcagcttcagaaaaaacagcaaaaagccttgcgcgcttcaacagcggaacagcggagagaaaagcttcaacgctttttagattccgtcatcgcccatgaagaagaaatcatcgaagcgatccgcaaagacgtccgcaaaccatatcacgaagtcaaaaaagcggaaatcgaaggaacaaaaaaagcgattagagataatatgaataacctggaacaatggatggcgcctaaagaagtcggttcatcgttaagccctgacgcaaacggaattcttatgtacgagcctaaaggcgtcacactcatcctcggcccgtggaactatccgtttatgctgacgatggcgccgcttgccgcttctctcgcagccggaaacagcgcgattgtgaagctgtccgatttcacgatgaacacgagcaacattgccgctaaagtgataagagacgcttttgatgaaaaagaagtcgcgatttttgaaggagaggttgaggtggcaaccgaactacttgatcagccgttcgaccatattttcttcactggaagcacaaatgtcgggaaaatcgtcatgacagcggctgccaaacacttggcatctgtcacacttgagcttggcggcaagagcccgacgattattgacagtgaatacgatctgatggacgcagcgaaaaagatcgccgtcgggaaattcgcaaacgccggccaaacctgcatcgcacctgattacctgttcattaaaaaagacgttcaggacaggttcgcggggattttacaaacagtcgtcaacgctggatttatggaggatgatcataccccagaccgcagcaaatttacgcagatcgtcaatgaccgcaacttcaaccgcgtcaaagatctgttcgacgatgccatcgaaaaaggggcggaagtggtgttcggcggcgtatttgatgccagcgaccgcacgatctcgccaaccgttttgaaaaacgtcacgcctgatatgaaaatcatgcaggaggaaatcttcgcaccgattctgccaatgatgaactatgaagacatcgacgaggtcatcgattacgtaaatgaccgcgataaaccgcttgcactttatgtgttcagcaaaaaccaagacctgattgacaacgtccttcagcacacgacatcaggaaatgcggccatcaatgatgtcgtcgtccatttcagtgacgtcaacctgccattcggcggcgtcaacacaagcggaatcggctcctatcatggggtatacggattcaaagagttttctcatgagaagggtgtatttattcaagcctctaaataatcataatgaagagaatctgcatcatcttgcaggttctttttttatctttatatcacctaaataaagagattaaaagtgataaaatacaattttcaaacgagacaaaattcctctagtctatctcattgaaaccctgcagcccctaacgtataatacccagaaaactttaaaggagtaaaatgatacatggaaaaaccagcaggattttggattcgggcagccgcctctattattgatgtatttattatagctatattctctttcattatgattttattaacaccttcattgtgttgccactcattgatgcagcaggtacacacatgtcagaagcccgatatgagtttttcatgttgatcattggcacaatccctgttttggccatcatatttattttcgctattctttactatagcttgctgacttcctcaaacatgcaagcaacattgggaaaaaaactcatgggcatcatcgttgtcaatcagtatagcgagcgtatttctttttggcacagcttcggccgtttcttcgcttacacattatttaagatcttatatatcggttttatcatggcggcctttccctctaaactggcattacataattatatttgcgggacaaaggttgtctataaaaataaatatcttgattgatcaaaaaaacaggctgccgagttaacctcgccagcctgttttactatttcccaaaagccatcagcttcgtataacttccaatataaagcgttccgtcctcagcgagctgaggagatgacactacgttgctgtcggtttgatatttccataattcattgccgtttgcgtctgccgcataaaccttcatatcatctgacccgaaataaaccgttcccttcgcgtcaatcagcggcgccgttctgacagggccgtctgtgtagaatgaccagttcatatccccgtttttgctgatggaaaacagctcgccgcttcctgagccgatgtagatattgccattatgatcaatcgcaggagatgagctggagaacccgtttagcgggaatgtccatttcaaactgcctgttgatgtataagcatacagctgtccatcttggttgccggcataaatgtttccgtccttatcaatcaccggatatcctttaaacgcatttgacgtcgttctggaccatttcacctgtccggttccggagttgatcgcataaaacacgtaattatatgtgccgacatacacggtgccgtttttggcaagcaccggcacagagctgacgacaccatttgttttcaacttccagcgctctgtccaggttgattttgacgtcggtttgatcgcgtgaacataattatcaagtgttgagaaatacaacgtcccgtctgaaccgatcaccgtttcagagcttggcccgccgcttaacggaaccgttgttaaaatttctcccgtttctttgtcaataaaataaatctttttgtcataggatgccaaatagataacgccgttggtcccaagtacaggagattgcgtatatgtttttccaagattgcccgtcacccatttgactgagccgtctggattaaaggctttcatttccccgtctctggaatgaagatatactgtgccgtctccgtcaatcacagcccccgctccattttgcggagtcgttctgatgtcgttttgccatttcagcgtcccatctgtatttccggcgaaccggctttcgcgtgaccagttaaacatggcaggcgccatcgcttgtacatcatatcttcctggcaaaaagccagatgctccattattttgagaaaacaccgtttccgccgcataagcagctgtcggctgaagcactttggcagcgggcacatcagaaacagcgccggccgaaacagccgccgccaccgcagctcccgcaatcaaagctttcatacgaaatgacttgaccatcattgagacccccattatatgtaacttctaatttgtgaccatcataacatattcatccattttataaatctatttcacaaaaacatcacaaactagaaaactatgtaagagtattcacggacgttttttcagcacccggccgaaatgcagccacaaaccaaatgacgttgacagcagccgcagcgagactaattccgaaaacaaagatcacctcagaaagcagatggtcactaaagaaactaaacatcaagataaaaccggccgaagacaaatgaatcaaaagcccgaagccgcaaagcaccgccatgacatacctcattgcatcgactccgagcatataaacgagaaatggaatgaaatacaatacaaggatcataccgacagctgaccacatgccagctgaattaaactgattggccgccgctcccgttccggccagcggcgtaagtgaagccgccactatcacggcgcaaaaaagaaacgcagaaatggttgtcatgatcgccacgctattttttttagacatcaaactcctcctttaatagaaatattaacctttttcattataagtaagttgaatgttatattcattatattttttaaaaaaatccagatcgtacaaaaatgatatgattctttctagtatatttatatagtaaaaaacaaaggataaaagactcatttttctgtaatatcaggattttatcaccataccatattgcatgtacttgtttttcaaagtatactattccagattaattcagaggagagagaaaaatacatggaaaaaccagcaggattttggattcgttttttagcttattttattgatggcattattgtatctgttcctagttatattattctatttgtgatcaattctgtttttgtagctggggctgtggcaacaaacccttacatgacggaagaagagtatttagtgaaatacatgacgcttgcatttttgcctactatgctgatcatgatcgtcatcagtgtgttatattacgggctgctcacagcttctaaaatgcaaggcacacttggcaaaaaaattcttggcctgaaagtggtcaatgaacaaggtgaacgggtttctgtcggacagggaattggccgttactttgcctatatcttatctggaatcatcttttatatcgggtttatcatgatcgcctttggagagaaaaaaggcctgcatgacatcatttgcaaaacacgtgtcgtgtataaataatagaaaaaagtctagacgccaataggcatctagacttttgttttctttacaataggctgccacgacagatacgtagcgcttctccacagccactcaaacggccccatccgaaagacacgaagccaaaggtggctgaagaccatttgaacggcacaaaccgtaattgtaatgagcacaccggcagcagggtacacttttccatacaggcccaagccgtaatgataaaaaatccaagtacacacaatagactgcatcaaataattggtaaatgccatcctcccaacagcggagaatgattgcagcactgttctcactcttgttttatgataaagatagacaaccgttgtaacatagaaaaacatgaggaaaggcgcgccaatcagcagaaatagttccttttccgttacactgtacagcacatgggcgccgatgccgatgacaagcccagccatccataatcgttttaatcctttgcgatgcttttccggttcatgcaaataccgtgattttgctgccgcagctcccagcaaaaacatgctgaaataaggaatggatgcaaagaagaagttgagcggattatacgtaagcatgccattcgaagacatataaacaagacggtcatggatccgctgttctgcaatgtccttcaggctgccgcttccataaacatgaatcgcttgtgttgcctgctgtgttaccgcttgtacccattcctgtccgtttgattgatcaaaacttgtcaacatgaacggaatggaaaacagaagatacaaagagaccgcccatatcagcagtgttttcggctttgcttttcgaaacaagagcaggacaaaaccgagcaaggcatattctgttaaaatatccccgtcccatatcaaaaaggcatgaatcgttccaaacaagagaagcgccattaaccttctcacatataacggaacaaaccgtttccctttgttttctgctctctccatcatgacaaccatgccaaatccaaataaaaaggaaaacaataaaatacattttgtttgaatgaagaatttcagtatgtctgcggcggcaaaatcagcttcagaccacttatccatgaaaaaattctcttttccaagcatagacaaatacatatccggataactgaaatgtgccagattgacaaataagatgccgaaaatcgccattcctctcagcacatcaagcacaccgatccgctcatttgttaaagtcggctgtaatgaagacatagccatcacgctccttttttctgtaccttaagggtatgaaaaaatgaagcgcggaaacatcgatttaggtgtcaggccggcatgaaaaccttacaatcttgtcatctttatggtttcatcacctttaaatctaatgcttcgatattctgcaaaacgcgatcaaaacgcaaagcctgaggctcacatgggaagatgtggccttcatacgggtcgcctaacgtccggaaaaacggttcaaataaaccaggaaccaatacgcccaccatctttgtatagtaagaatcaaggcgataggagtgaacggtatttgcagggacatgcaggaaatctcccggattcagctgaatttcctggccatctgcccacatcgtcatctggccttcaaggcaataaaatgtttctgtatgatgttcatggtagtgatcaacgattcggtcacctttagggccttcagaggatacgacgataaactggccatctgtatttttttgtgcagccacaatgcggtgaagctgatctccagtcaacaggcgatctccttctccagattcaagaacgtatggaaccgctccatctggcagctctgtaagttccgctaatttggccgaacatgcaggcttttcttcatctagaaatacaatgtccgctacagcggctgcttctgcaaatcgctcgtttgagacttcttcgcttgcgtacggcggatgttcagcgtgatcatacggattcccaataacggaatacaagtgcgctacgtttcctttcatcgtgtaagataccagtcttgttctgtggctctgcatccggtagctgtgcggtgttcccgccggaatgttggcataatcacctgatattaataaatagcgttcaccatcaagtgtcagttccagtttcccgtccaaaacgagaattccttcatgtgtgtccttgtggacgtgaagcggaaaggcatctccttttcccccggaaagaagcacgatctcaaacaaatcacctgtgctcctcccattcgcaatcaccgtggcaacctgtctgccgaacagatagcgctcgccttctccgctccggagcaaataaggcattttttctttgggcaatgaatgtgtacataatgttttcatattatcgcttcctccaatttagaccagtctatatactataactttctgactagaccgttctatataattgtaggagaaaggataacaaaatgctaccctttttttctcaccagcactggtatttgttcggcaatgagaagaagaggcgttttgtctttattcgttaacgaaagcatgatgccgccctcaatcatcgaattaatcagcgttccaagctgatttgcttcttcttctgcaaatccgttttccattaattttctggcaaaaaccgcttcccagcttttaaacaccttcatgcaaaccgtccgtagcggttcactgattaacgctgtctcactcgccagcaaaccgactggaatacctttaatgctttctgtgttgtcaaattggctggctgtttttttgataaaaagctgaatcgcttcaataggatcagaggattcatccatgctttgctgtatcagatgttcaacgatcttacctgtatatgtaaccgcttcaattgctaattcttctttgccattcggaaaaaagtgataaagcgatcccttaggagcaccgctttcttttacaatctggttcaaacctgtcgcgtgatatccttgcagctggaacagacgtgacgccgtgtgaaggattttttcacgtgaatctcctctgctagtcattaaaacattccctcctaggtatggtagagcgacttatataatataaaaaagaaccctgtgattgtcaaaaggggtaagacccttccggatggggtaatgtacaaaaacagcgtctaggagggatctctcaatgacaatcgatcattcagtcacgaatacagagcagcttgaacaacagaaccccggcatgaaaacgaagatcaaactgaaaaaactcaaggatcaggtgatcgtcattaccggcgcttcaagcggtatcggacttgtcacggcgagaatggcagctgaaaaaggcgcaaaggtcgtggcagcagcgcgaaatgaagacgcgctgaaggagctcactgatgaacttaaggaaaaagggcacgacgccatatgggtaaaggcggatgtcggaaaagaagcggacgtcaaccgcatcgcagaaaccgcgatcagcacattcggccgctttgacacatgggtcaacaatgcggccgtctcgactttcggacatgccatggacgtcaccgttgaagacatgaagcgcatgttcgacacaaatttctggggacctgtttacggaacaagagcggctgtcaaacactacactggcagaggtgtgccgggcgcactcattaatgtaggaagcctgttcggagacaggggaacagtcattcaatccacatatgcgtctgccaaatttgcgcttcacggctggacggaaagcatccgaatggagcttgaaaaggaacaggcgcccgtctcggtaacgctcatccacccgggcagaattgacacgccttataacgagcatgcgcacagctacctcgacaaacagccggctcattaccgctccatgatctatccgccggaagcagtcgccgaagctatcctgtttgccgccgaaaaccctaagcgcgacatgtacatcggctcacaggccaaagccatcgccatgctgggcgcgcttttccctcgtctgaccgacagactgatggaaaaaatcatgtatcacagccagcatgccgaaagaccgtccaaaccgcgagaagaaagcgctctttatgatgcgggctgcggtatgcatgacagaggcacaaataaaggatggatgaggtcaagaagctactacacaaaagcgacgaagcgccccattgtatcggcggctgttgttgccggactagtggcttgggctgccgccaaacgatgcagataatctctgaccatgatagaaaaacccatgctgttccagcgaaccatgggtttttcagctgttaatcgataaaagccttgttcatacgctgcagcagctcgccaaacatctctttttcctgtgttgaccattctttcagcatctgttcataacgttcaaggcgcttttgctgatcggcttttaatagttgtttgccgagttttgtaatggtaaacaggctgactctcccatcagatgggtctgagaaacgatagatgagctcctttgcctctaatgcagctgcttgtcttgaaagagtagaaatatcaagcttaaacgattctgccaattccttaacacgagcaggcccaaactcatccaattgtctcagtaataagtacgaagatctctccaaattccctgttcttttctccgattgatccagataaacagctctcctgataaaagtcgtcagctcatattcaattaattcaactggattttgattttgcaatcgctctcgctccctattccaatctccggcattgacaacatcatatatacttgtataatacaaatgtacattaactgaataaatacaagtcgttatatgactaaatcaattattatacttgtatagtacaatcatataaaaagaaagtaaagcgattcctcagaaccatcctagaagcaagcaccagaaaggaggaagctgttctgattggagagcagcacttgatgtgaaagtcatacgaattattttgcaagtgttgatattatatgtattttttatgatcggggaagccattcagcatctgtttcatttacccgtgtcaggaagcatcgttggattggtattgcttctgatctgcttgggcctccgtattgttcccgtctccatcattgaagacggagcagggtttttattatccttccttccattgttgttcatcccggcaatgacaggagtgataaactatccgtctctcatttcattcaatggcctgatgctgctgattacagtcgttctgagcaccatcgtcacgatcattgcggctggattcgccagccagctattagagaaaaaagcaaaaaaacgggaggagaaagagaaatgcagcaagcatgtatcgcgatcattataattcttttaacagttgccgcttatttagcgatggtcaaactctataagcgattcccgcttccatttcttatccctgttctgacaacgaccattttgattgtagcggctttgatgatgtttcatgtttcctatgaaggctatatgatcggggggaaatggatcaattctttgcttgggccggctgtcgtggcactggcctatccgctttataaacaatggcatatcattgtcaaacattgtgttcccattttaggcggcgtcctggtcggattatgcatgggaatgatcagcgggctgatcttcgcagaagcattcgggattgatcatgatctcttattatccattctgccaaagtcgatcacaacccctgtcgctattcagatcgccgccggtcttggcggcgtcccttccatgacagtcgtatttgtcatgattgcgggcttttcaggcgtcatcctcgggccgcttttcctaaaatggcttcgcatacgcagttccctaggacaaggcattgcattaggcagcgcctcccatgcactaggcacctccaaagcattggaatatggagaactggccgtctccatgagttccgtctccatgacgctttgtgcggtgctcggctcattcttcggcccgctcgtcgtctggctgtttcatatttaacaaagaaagactgccccgggggagggcagtctttttcgtttaagaagcaaaaaaatcaatcagcggctgaaagtccttagataaatcaacgtcattcggttctgcttgaagcaggcggtcaatcatacgctccagctcctcaacatcattcttatccgtatattcaatgaagtttaagctttcaagccaatcccgatatgaatgtttggctttgccatagctgtttccaaagacaaggcaaggtgttttggtgataatcgagaaaatcatcgcgtgaaggcggtcggtaatcaccaatttactggagccgatgcggtccagcatctccataaaatgcttttcacgatcagcgtaatcgatggtgtctaccgtatccagcaccgtatcggtacgctctgtgtaagttgttttttctgcccattgcttcatctgtgaaataaaatcttcgtcagtcactttctccttatccgctcttaaaataaagagaacgccgtcccgctcgagctctcgcggcacaatatccaaggaaagcaccatgtccggtgtaaagatcacattggagttgaaggtctctttcacaacatccagtgtttgcgtctcacgcgcagcaatcgttaagtttgtattttgatggtacgcatcctgtgtttttttcttttccttctgtccttcctctgtatcctcaaaataaacggattgtggcagagaaattgatttgtagtctttaaacgccgaaaagacctttcttctgtcttcctcaatatcgagataaaggtttcctaagttccctccgcctgtaaagcagacaatatcgtcttcacgaatgatctccttcaccagttcaatgccctcatccgtcgcataatccataatctcaatgtattcataatacggaaaatgatttttgataaatttctcttccgcatacgcaatcgcttggtctccaatgtttgtgtaactaggggaaccaaacaaaaatacttttcgtttatcatttaacagagcttccggctccacatttggcgcaatgccttttactagttttttgcctttgattttttgtacagtcatatctgcgtcctccttctgggatgaattcctcattgtgtgttaactgtctctacccaaaaagaaggatggctatgcattggcatgtgcatcggctatatcagaaacatcgttttcgccaatttgatagacgctgcaatgtcccgcgccgttctttccatatattccgcggcatgttcaaacgcatcttctagcggcacggctccggggacgatgctgaaaagcgcatcgattccgtgttgatagacggcatcactgtcacgtgatactgatcccgcaataccgatgacaggcacatcatatgatttagccgccttggctacgccgatcggcgtttttccatgaaccgtttggctgtcgatccgtccctcgccggtaatcacaagatctgcatcctgaacgatactttcaaaatcaaccgcttcaaggacaatatcaatgcctcttttcaggtcagcctgaagataagtcagcaggctccatccaagaccgcccgctgcaccggcgccctctgtatctcggaaggttgatccgagctctttttctgtcatatcagcgaaatggcttacgttctggtctagtacatccagcatgtcggccgtcgcgcctttttgcggcccgaaaacagccgtagcgccctttggtcctgttaacggattgtccacgtcacaggcaacttccagtttgacattccgcaatctggaatcaagcccgccaacatctattgatgcaagctgagataacgcgccgcccccgggccaatctcgcggcctgagttatcaagaagccttccgcccaatgcctgaatcatcccggctcccccgtcgttcgtggcgcttccgccgattccgatgatcaatcgctccgctcccgcatcaagagctgctccgattaattctcccgttccccttgttgtagtgatgagcggatttcgcttatctacaggcaccagatgcagccctgaagcagcagccatttcaatcacagctgttctcccatctcccatcatgccaaagaaagctctcaccggttcccccagcggccctgtgacaacttgctctatgatccttccattggtcgcatcgaccagagattgaacggttccctcgccgccatccgccaccggcaattttctgtaatcagcacccggaaagaccgatttgaaacctctttctatcgcttcggctgcctccagagctgataagctttccttaaaagaatcaggtgcaatgatgattttcatccaaatcgcctctttcaaaacatgattcacttacgctagttatctccaatgtaccatattccatttagaaataaataccataatgattgggaaaaattttattaaaaattagaaatgaaagtgtttgcataaaagaaatattcacgttatcatacttgtatacaagtatacttcttgagtgaggaaggtgagtgtatgctagactccaaagacctgttgtatcccgcaaaatggctctcaaaagcgtcaaccggagttcgtgtcgcatacgagctgagaatgcggatcgtttcaggtctgattgaaagcggtaccattttatcagaaaatacaatcgccgccgagttttcagtaagccgttcgccggttcgcgaagcgctaaaaatactcgcatccgaaaaaatcatccgcttagaacgaatgggagcggtcgtaattggtttaactgagaagaaaatcgcggaaatttatgatgtgcggttactattagaaacatttgtctttgaacggcttgtcaaaatagacattgagcctttagttaaggatctcagcaaaattcttgaaatgatgaaagtctcaatcaaatatgaggacgctgacgaattttcatttcaagatgtgctgttccatgaaacgattatccgagcgattgatcattcatacattcagatgatctggaacaatctaaaacccgtcatggaaagctttattcttttatcgatgcgggtacggttaaaggaaaagtatgaagacttcacaaggatcttagataaccacgagctttatattcaagccatcaaaacaaaggatagggtgctgatgattcagtctcttcaccaaaactttgatgatgtgcaggataaggtagaagacctatggctctcacaacaaatgctggcaaaaggagctgaatacaacaatgactagttatatgttaggaatcgatatcggcacgacaagcacaaaagctgtgctgttcagtgaaaacggagatgtggtacagaaagaaagcatcggctacccgctctatacaccggacatctcaacagcagaacaaaatccggaagagatttttcaggcagtcatccatacaacagcgagaattacaaaacagcatcccgaaaaacaaatctctttcatttcgttcagcagcgccatgcacagcgtcattgcaatcgacgaaaatgacaagccgctgacgccatgcatcacatgggccgacaacagaagtgaaggctgggcgcataagatcaaagaggaattgaacggacatgaggtgtacaaacggacgggaacaccgattcatccgatggcaccgttaagtaaaattgcctggatcacgaatgaaagaaaagaaatcgcttccaaggcaaaaaaatatatcggcatcaaagaatacatttttaaacagctgttcaatgagtatgtcatcgattactcattggcatcagcgacaggcatgatgaacctgaaaagcttggcttgggacgaagaggcactgcgcatcgcaggcatcacgccggatcacttatccaaactcgtgccgacaaccgagatctttcagcactgcagcccggaaatagcgatccaaatgggaatcgatccggaaacgccttttgtcatcggggccagcgacggcgtgctgtccaacctcggcgtcaacgccattaaaaagggagaaatcgccgtcaccatcggtacaagcggtgccatccggacgattattgacaagccgcaaaccgatgaaaaagggagaattttttgctatgccttgacggacaagcattgggttattggggggcctgtgaacaatgggggcatcgtccttcgctggatcagagacgagtttgcctcctccgaaatcgaaacagcgacacggctgggcattgatccatatgacgtgctgacgaaaattgcccaacgcgtcagacccggttctgacggtctgctgttccacccatatctcgccggagaacgcgctccgttgtggaatccggatgtacggggctcatttttcggcctgaccatgtcgcataagaaagagcatatgatacgcgcggcattggaaggcgtcatttacaacctgtacacggtgttcttggcgttaactgaatgcatggatggcccggtaacccgcatccaagcgacagggggatttgcaaggtcggaggtttggcgccaaatgatgtctgatatcttcgaatcagaggttgtcgttccggaaagctacgaaagctcatgtctcggcgcctgcattttaggcctgtatgcaacaggaaaaattgactctttcgacgccgtgtccgacatgatcggcagcacatacagacatacgccgatcgaagactcagccaaggaatacagaacattaatgccgattttcatcaatctatcaagattattagaaaatcaatatacacaaattgcagattatcagaggggcttaatcacacacaaatagtacatgacatgaaggggagggcattaccatgccgttaatcatcgttgcacttgggatcttagcattactatttctgattatgggcttaaaattaaacacatttatttccctgctggtcgtatcgttcggcgtggcactggcactcgggatgccgttcgataaggttgtcagctccatcgaagcagggataggggggactcttggccacatcgcgctcatcttcggactcggtgcgatgctgggcaagctgatcgcggattcaggaggcgcacagcgcattgcgatgacgctcgtcaacaaattcggcgagaaaaatattcaatgggccgttgtcattgcctcatttattattgggattgcgttattttttgaagtaggactggttctattaattccgattgtctttgcgatttcaagagaattgaagatttctattttatatctcggaatcccgatggtcgcggcactatccgtcacacacggtttcctgccgccacacccgggacctacggcgatcgccggtgagtatggcgcaaacattggagaagtgctgctgtatggctttatcgttgctgttccgacagtgctcatcgcagggccgttatttacaaagtttgcgaaaaaaatcgttcctgcatcatttgcgaaaaacggcaatattgcatcactcggcacacaaaaaacgtttaaccttgaagaaacacccggctttggaatcagtgtctttactgcaatgctcccgattatcatcatgtcggtcgcgaccattatcgacctgcttcaagaaacaatcgggtttgcagataacggaattttagcttttatcagattgattggaaacgcatcgactgctatgattatttcgttattggtcgcagtctatacaatgggcatcaagcgcaacattccagtcaaaaccgtgatggattcttgttcaactgccatttcacaaatcggcatgatgctattgatcatcggaggaggcggcgccttcaaacaagtgctgatcaacggcggtgtcggcgattacgtagcagacttattcaaagaaacggcattatcgccaatcattctggcatggctcatcgcggcgatcctgcgcatttctctaggctcagcgactgttgccgcactaagcacaacaggtctggtcattccgttattgggccattctgatgttaacctggcgttagtcgtactcgcaacaggcgccggaagtgtcatcgcttcacacgtcaatgacgccggcttctggatgttcaaggaatacttcggattaagcatgaaagaaacattcgccacatggacattgctggaaaccattatttccgttgctggactgggattcattttattgttaagtttagttgtatgaaattaagaaggagctgtaacacatgttcaattcgattggtgtcataggcttaggcgtaatgggaagcaacatcgccttaaacatggcaaataaaggtgaaaacgtcgctgtctataattacaccagagatttaacggaccagcttatccaaaagctggatggacaatctctcagcccgtattacgagcttgaggactttgttcaatcgttagaaaaaccaagaaaaatctttttgatggtcacagcgggaaaacccgtagattccgtcatccaatcattaaagcctttgcttgaagaaggcgacgtcatcatggacggaggaaactcccactatgaagacacagaaagaagatatgacgagctgaaggaaaaagggattggctacctgggagtcggcatttccggcggtgaagtcggcgcattaacagggccttccatcatgccgggcggagatcgcgacgtctatgagaaagccgctcctatcctgacgaaaatcgcagctcaagtcggagatgacccttgctgtgtctatatcggaccaaaaggggcagggcactttacaaaaatggtgcacaacggcattgaatatgcagacatgcagctgattgcagaagcgtatacgtttctaagagaaacgcttcatctgccgctagatgaaattgcatctatatttgaaacatggaatcaaggtgagctgaaaagctatttaatagagattacagctgagattttacgcaaaaaagacgaaaaaacagggcagcctctgatcgatgtcattcttgataaaaccggacaaaaaggcactgggaaatggacgagcatgcaggcgattgataacggcatcccgtccacgatcatcacagagtccttgttcgcccgctacttgtcatccttaaaagaagaacggatggcagctcaagacgtattagcaggcccggaagccgaagaaaaacacttggataaagacacctggattgaatacgtcagacaggctctttacatggggaaagtatgcgcctatgcacaaggctttgcccaatataagatgtcatctgagctttacggctggaatctgccgctcaaagacattgccttgattttccgaggcggctgcattatccgcgctgatttccttaacgtgatcagcgaagcattcagtgagcagccaaatctggcaaacctgctgatcgcgccttatttcacagataagctccatgcctatcaaacaggcctgcgaaaagtcgtttgcgagggaatcagcactggaatctccttcccatgcttaactaccgcgctctcttattacgacggctaccgcacagggcgttccaatgcgaacctcttgcaggcgcagcgcgattactttggcgctcatacgtacgaacggactgatatggacggcgtcttccatacgaattggtctgaataacctgtcatcaaaaacacggtcagttttcaactgaaccgtgtttttttcttctatcccaaacaacagaagacataagttatgttttaaatatcataaacagtgatacaataatagctagaaacaatccccaagatcatcatgtgacagcagcttgctgttccgttctattctgcttttggccattgtcctttgcccttgcccatggtgtcataaaatgttcaaatgccaaaacggcctgtcattctgatttacaaaagtccctgaaaaccttgtctaattgagaatcagcctctcatttgttataaaagaaatgcataaatcctacctgtcacaccttaaataagttgaaaaaaagtaggttatcgcttgacaaaaaatatatattaattaataattcatatataattagaattattattgaaagcgaatatgctttctaatacatttttaggaggaatatacattatgtctttaatcggtaaagaagtacttccattcgaagcaaaagcattcaaaaacggtgaattcatcgatgtaacaaacgaagatttgaaaggccaatggagcgtattctgcttctacccagcagatttctctttcgtatgcccaactgagcttgaagatcttcaagaacaatatgctgctcttaaagaattaggtgttgaagtatactctgtttctacagatactcacttcgtacacaaaggctggcatgacagctctgaaaaaatcagcaaaatcacttacgcaatgatcggtgacccatctcaaacgatctctcgcaacttcgatgttcttgacgaagaaactggccttgctgaccgcggaacattcatcatcgatccagacggcgttatccaaactgttgaaatcaatgcaggcggtatcggccgtgacgcaagcaaccttgtaaacaaagtaaaagcagctcaatacgttcgtcaaaacccaggtgaagtttgcccggctaaatgggaagaaggcggcgaaactcttacacctagccttgatctagtaggtaaaatctaaggagtgcattcaattggtacttgatgcaaacatcaaagcacaattaaatcaatatatgcagctaattgagaatgacattgttctcaaagttagcgcaggcgaagatgacacttctaaggacatgctggctctcgttgatgagctggcttccatgtcatcgaaaatttcagttgaaaaagctgaattaaacagaacgccaagcttcagtgtcaatcgtgtcggagaagacactggcgtgactttcgccggtatccctctgggccacgaattcacatcattagtgttggcgctgctccaagtgagcggcagaccgcctaaggtggaccaaaaagtcattgatcaggtgaagaagatcagcggtgaataccacttcgaatcttatatcagcctgacatgccacaactgtcctgatgttgtacaagctttaaacatgatgagcgtgctgaacccgaacattacgcacacgatgattgacggtgcagcatacaaagcagaagttgaaagcaaaaacatcatggcagtgccgaccgtttacctgaatggcgaatccttcggaagcggccgtatgacgcttgaagaaatccttgcgaaaatgggcagcggcgcagatgcatctgagtttgctgacaaagagccgtttgacgttcttgttgtcggaggcggacctgctggtgcaagtgcagcgatctacactgcacgtaaaggcatccgcactggggttgtcgctgaacgcttcggcggacaggttctcgacaccatgagcatcgaaaacttcatcagcgtcaaagcgacggaaggaccgaagcttgcggcaagtcttgaagagcatgtgaaggaatatgatattgatgtcatgaaccttcagcgtgcgaaacgccttgagaagaaagatctgttcgaacttgaactcgaaaacggcgctgttctgaaaagtaaaacagtgatcctttcaacaggtgcacgctggcgcaatgtcaacgtacccggtgaacaagagttcaaaaacaaaggtgtcgcatactgcccgcactgtgatgggccattgtttgaaggcaaagacgttgcggtaatcggcggcggaaactctggtatcgaagcagcgattgatctagcaggtattgtgaatcatgttactgtgctagagttcgcgccggaactgaaagcagacgaagtcctgcaaaaacgtctctacagcctgcctaacgttactgtcgtgaaaaacgcacaaacaaaagaaatcacaggtgatcagagcgttaacggcatcacatatgtagaccgcgaaacaggcgaagaaaaacacgttgaacttcaaggtgtattcgtccaaatcggtctcgtgccaaacacagaatggttagaaggaacggttgaacgcaaccgcatgggcgaaatcattgtcgacaaacacggcgcaacaagcgtaccaggcttatttgctgccggcgactgcacagacagtgcgtacaaccaaattattatttctatgggatcaggtgcaactgccgccctcggcgcgtttgattacctaatccgtaactgataaaaaaatccgctatattgccagattggcaggatagcggatttttctttttctacagaaaaaacccgaaccaggcactccggtaaaagtgctcgattcgggccagcttcttataggtcctcgccattcgtttgaatgacatttttgtaccactcaaaggaatctttcttataccgcttcatggatccgtttccttcattgtcacgatcaacatagatcatgccgtagcgttttttcatttcgccagttgtgaaggagacaatatcaataatgccccacggcgtgtagccaattaaatcaacaccatcgtacgtgaccgctttttctaatgcttcaatatgcgattttaaatattgaatgcgttccggatcatgaaccttgccgtcctcctccagcgtatccactgcgccaaagccattttcaacgatgaataacgggatttggtaccgatcataaaaacgatttaacgtatatctcagcccggttggatcaatcgcccatccccagtcactcgaagtgatatacggattttcgacaccattcggcaagccgccattgacaatatcgccagtgttatcatttttcacatcgcttttcacagttgttgacatgtaatagctgaagcctaagtaatcgacggttccgtttcttaaaatctcatcatcgccgtcttcgaatgtgatgttgtagccttcgcgttcaaattccttcaacgcgtagcttggataataaccgcgaacctgtacatcagggaagaaatagcgctgcctcatttcttcttcagccagcatcacatcttcaggattggaggagaaaggataaatcggcacgtgtgataccatagccccgatctggaactctggattgatgtcttttccttttgccactgctaaggcgctcgccactagttcgtggtgtgccgtttgatacatgacctccttggcgttttcgttttcgccaaccacaacacctgaattcgtccataggaacaacggattgttcacatccatttggttgttgatctcgttaaatgtcatccagtactttactttatctttgtaacgggtaaagcaagcctctgcaaagttgacgaagaagtccacgactttccggtttctaaagccgccatattctcttgccaggtgcagcggcatttcaaagtgagacagggtaatgaccggctcgatcccatgcttcagcaattcatcaaacacatcatcataaaactgcaaaccagcttcgttcggttcagcctcatcgcctttcggaaaaatccggctccagccgatggacgtccgcagacattttaatcccatttccgcaaacaaagcgatatcttccttgtatctgtgatagaaatcaatggcttcatggttcggataaaactcgttctcttcaatcgtatccgtgatttttctcggcacgccatgtgcacctgctgtcatcacatcgacgacactcggccctttacctccttgattccatccgccttcaaattggtgggcagctaaagcaccgccccataaaaaatcctttggcatgtttcccatgtttaattcctcctcagcttacgactgtaaatattttttgatgcaatgcactttcctcaatctcttcaatgaaagctttaacaaactcatcgccttttttgacggtatcgccttcttttaccttcaaggaaaaaggcgtgccgtcaaatgtcaccgtatccagcccgatgtgcgcaagcaattcgacgccggacgctgaacgcagctttgtaggcgccaccatgacaaccgtaataacgccgggatggtggcatcgattttacgatatccttcgctttaggggtagaccgcttcagcaccaatcgaagtctggtagcgcagcgagaagccccaatcacattctcttccccgcctacggcctctaaaatgtcttttgctagtctcgtataatctctcacttccccgacatttcacccacccctttgatttggttgcgctttcattataattgtaccggtataatatatcaataccgaaacaaaatatttacgcactaactatcattgtaagcggtttatgctataattttggcagtgaaactaaacgaataaatgaggaatgcgtatgttaaaataccagcaaatcgcagcggaaattgaaacatatatagaagaacaccagcttcagcggggagacaaactgccagtcctagaaaccctcatggcccagtttgaagtcagcaaaagcacaatcacaaagtccctcgagctattagagcaaaaaggcgcgatctttcaggtcagaggaagcggcattttcgtcagaaaacataaacgaaaaggctatatcagccttctgtcgaatcagggatttaaaaaagacctcgaggatttcaacgtcacctcaaaagttatcgaactagacgtgagaaagccaactccggaagcggcggaaaacctgaacatcggaatggacgaggacatctactatgtcaaaagggtccgttacatcaatggccagaccctttgctacgaagagtcttactacaacaaatcgatcgtgacgtatttaaacaacgaaatcgtctcccactccatcttccattacatccgggaaggactggggttgaagattggtttttctgatttgtttctgcacgtgggccagcttaatgaggaagaagcggaatacttgggattagaggctggactgccgaagctgtatatagaaagtatttttcacctgacaaatgggcagccgtttgattactcgaagatttcgtataattataagcagtcgcagtttgtcgtacaggctaatagttttttgctgtagagctgcttcactatggaaggtggtcgacatgaacaaaatcatcattcctgcaatactagccatctttgcgctctggatattcttacagatttcactagagatgagcatcgttaagaatccaatgaactactttatcgtattcattatctttttcctctttgtaaagatggtgaaagaaaaacaataatagtttactttgaacaggaaaccagatttgacatctggtttttttgtgtttcactttattcatccgtttcaattgtctctaaaagcagttatgcggtactatcatataaaggtccaatgtttaaaaataatgtcatacttttaaattcaccttatcatgcacatgatcatatataggggtttattctaaaaaggggatggacgattttggaaagcaagtacctagatctactcgcgcaaaaatacgattgtgaagaaaaagtggtaacagaaatcattaatttgaaagcgatattgaacctgccaaagggcactgagcattttgtcagtgatttgcacggggagtatcaggcattccagcacgtgctgcgcaatggttcaggacgagtcaaagagaagatacgcgacatcttcagcggtgtcatttacgatagagaaatcgatgaattagcagcattggtctactatccggaagacaaactgaagttaatcaaacatgactttgatgcgaaagaagcgttaaacgagtggtataaagaaacgattcatcgaatgattaagctcgtttcatattgctcctccaagtatacccgctccaaattgcgcaaagcactgcctgcccagtttgcttatattacggaggagctgttatacaaaacagaacaagctggcaacaaggagcaatattactctgaaatcattgatcagatcattgagcttggccaagccgataagctgatcaccggtcttgcttacagcgttcagcgattggtggtcgaccatctgcatgtggtcggcgatatttacgaccgcggaccgcagccggatagaattatggaagaactgatcaactatcattctgtcgatattcagtggggaaatcacgatgtcctttggatcggcgcctattccggttccaaagtgtgcctggccaatattatccgcatctgtgcccgctacgacaacctggatattattgaggacgtgtacggcatcaacctgagaccgctgctgaatctggccgaaaaatattatgacgataatccagcgttccgtccaaaagcagacgaaaacaggccagaggatgagattaagcaaatcacaaaaatccatcaagcgattgcgatgatccaattcaagcttgagagtccgattatcaagagacggccgaactttaatatggaagagcggctgttattagagaaaatagattatgacaaaaacgaaatcacgctaaacggaaaaacatatcagctggaaaacacctgctttgcgacaatcaatccggagcagccagatcagctactagaagaagaagcagaagtcatagacaagctgctattctctgtccagcattccgaaaagctgggccgacatatgaattttatgatgaaaaaaggcagcctttatttaaaatataacggcaacctgttaattcatggctgtattccagttgatgaaaacggcaatatggaaacgatgatgattgaggataaagcctatgcgggtcgtgagctgctcgatgtatttgaacggttcttacgagaagcgtttgcccacccggaagaaaccgatgacctggcgacagatatggcctggtatttatggacaggcgagtactcctccctcttcggaaaacgcgccatgacgacatttgagcggtatttcatcaaagagaaggaaacgcataaagaaaagaaaaacccgtattattatttacgtgaagacgaggcaacctgccgaaacatcctggcagaattcggcctcaatccagatcatggccatatcatcaacggccatacacctgtaaaagaaatcgaaggagaagacccaatcaaagcaaacggaaaaatgatcgtcatcgacggcggcttctccaaagcctaccaatccacaacaggcatcgccggctacacactgctatacaactcctacggcatgcagctcgtcgcccataaacacttcaactccaaggcagaagtcctaagcaccggaaccgacgtcttaacggtcaaacgattagtggacaaagagctcgagcggaagaaagtgaaggaaacgaatgtgggtgaggaactgttgcaggaagttgcgattttggagagtttgcgggagtatcggtatatgaagtgagggatgtggggttcagggattatattctttgggcccatttttacaatcaactataaatcaacaaaaagcctctcaaaatagggttttgagaggctcactatcaaacatgaaaagtacttctattagtgttaggtcttatgacttgatctacattctcagcaatcgatttataattttgtttttttgataaacgatcataatccccaacaatataaaactctttttttgcccttgtaactgcaacattaattaaattaggctttgagcacgaccaatttgccgctccatcactattttgatctgtccccactacaaagtaaacagtgtcggcttcttttccttgaaaggtatgggtagttcctattgagcttcgagtccaatcatttactattttctttggtacatttaattctgctaaccgctttttaattgtttttctgagaccatctttcactgctgtaaagggagtaataacatataaatcaggagcatttaatgtattttcccatttttgataaatctcttcagcaactaaatctgcctgctcttttacaaactgcttattaaccgctactcccttacagtcaaaccattcgcttttcccttgtttttttatcgctaaaaccattttattatcataagcaatttgattagcgattgtaaacattggatttaagcatctcctatgaacccataaaggtatccctatccactgtcctttattgttatacattccaaatggattcgccgcatccgccagtgattgtacagaactccctatttcaataaaccgatcttcaataccataaaatttttttatatctcctaatattgttcgatcaatggtgacaactggttcaatctggattggatcaccaacaacgacaactttttgagacctccataatgcgcctgccgcttgttgcggagtagcttgtcccgcttcatctataaataagtaacgaataaaatcacgaccaactcctttatacattgttcgaacactggcaaaggttgtacttattacgggtgtgattaaatggattacaccccacatatgttgtaaccacattctgtgctcagtctgatttaaatctaacttacttcgataatttaacaaacgcaaacttgattttattgctttataattaaatatcaaaaacaatttgtggactttcattccctttaaaaaaagaagccctctttcaaaattcaattcatcagttagccaaggagtatgtaattgcctatattcatatgcactttgagaattggtccaataattatcatcgggtattactaacccctgatttttgcatttattgttgatagaatccctatatttctttaactccatccttatttgattcgatctcatctgcaaaagatcccattccttttcttcattttttattttcatagttattttttgcagttgatcttccatctgtaataatttgtttctttttgtatgaaatattctttgaaaaaaagttggtttagaaagcgtgtgaaactctctctctaacaaccgtttctgttgtttataatgagctgtctttaatactaacttttcttgttctgcctctagtaacaataactgattatttatatccttatattttttaaaaatttcgcataacgattgtagttctgctttcttttgtttaactgatttcaatgtttgttggaaatctgttactgcattcttccaatctgttaagcttatttttttattttctcgttctaattgctcgatgaatgatagttcaaattcgttattatttctataataaagttttttgtaatagtgagatatattttccgactttcctaaagatgctgagaatagtccccaagtatctgtctcttcacctagaagagcctttgccgcaaaaggaaacatcgataattcctctgcttctaatgcatatgctttttcataagaagaaaatacattttcatctgtaactttacgtataacttccttctttttaggaagatcttttgagatattttcaactgctccattattgcttgaagccactaccatagaatactgattaatagatttatcaatttcataaatagtataatgatagccatctaaaactaatttctttatttttttcagagctttttctgggttttcaaaacaagccattttttctgctttttcaaccatgagatttgcaaaaatatcttttaacagtgtcgttttccctgttcctggcgggccattcacagagcttatcttttgattgttatttataatttgatttacagctacttgctgcattaaggataatctatgttcaacaggtgacggccacctgccgttaggtacatttttaggctgcaacacatcttcaattaaaactctattttcatcaatgttcgttctattatcaaccccttcaataaattgccgtagtgtttcattttctccttgtgagataatatctcctaagtcctctaagaaaaagctatgaaaattatttacccgtccatcttgtccaaccttcaaaatttctttctcaaaataatgaagcgccatattatctattcgtaaaaaataccgttcatatactccaagtactttcttaagggctttttctgttactccatttacaaagatggcatcaacctgttcctcaaataatctcaactgatctcgaaatgtagtcatcaaatcatcatatggcacttcaagatgttcgtttattaatttcatcacatacataagtacaggtacaaatgcagaatcctttacatacttgcctgtatggtcaactaaaaaagacatactaaataacattttctgatctctattaatcatttcttcattattttggaatagatcacgtagatagctaacaagtttatgttgctcaaagcaacctaaatagtaacgaaattgaataaaatttttttcagagtccttcaactgatgcctctcccaaggcctttcagaaaaaagaacttgttctgttttctttcgttgttgaccatctaaaaaatggcttctactcaattcatctcctataccattgactccgcttggtgataaagcctcaactaagtgccatgcccttaatacagaatttacatttatcttccccataattccctcctatttttaacaacatcattcggttattgtcctcaattgatccaactggtatctgtaaaaaatccctaaactgattgatcagtctcttttctttttttcgacacatttgtttaaatattgaataattaactagatcacacattaaaattattagattttagaacatttcattttagtaaaaattcatgactgattcataaactctgagatcatttgttaaatttatgatacgatgacagtaaaaaagacataacaggggctagtcatatgagtgaacttgtgtttgaaaaaagagattttaatacagaacaaattcttgcgttgaaggcatctcgattagataacaatccgattgtatacattctttataacgaaaaaaagaagccgactgcatatattgggcagactgtgcaggctgcacgacgattgaaaaatcatttgagagacaagaagcgaataagtttaacgcgaaccattttcattggtcatgaaagatttcatcagtcagcttcctacaatattgagacaaatcttattaattactttattgccgaaaatcactaccaattgcaaaatgtcagtcagacaagatcgagagaaatgcatcattattatcaaaaagaattttataacgaacatctttttgaggaaatttggaatcagcttcggaaagagaatgttgtcagcgacacccttgaaaacctcagaaataaagatatttacaaactatctccgtataaagagctctctccccagcaggtggaaatcaaaaatgaaattcttgatttttgcaaggcgcatattgaaaaaccaggtaaccatgtcatttctatagaaggagatgccggaacagggaaaagtgtcttactgagctctctatttaacacgattcaggatttatctaaagatgaaaattcacatttaaaaaacaagaacaattacttacttgtgaaccatggtgaaatgctgaagacgtataaaagcatcgcaaacagcttaccaaatttaaagaaaaaaaacttaatgaagcctacctcctttataaatcaaatgtcaaaaacaggggaaacagctgatattgtattagtagatgaggctcatctgcttttaaccaaagaggatagatacaataatttccactatcgaaatcagctagaggaaatcattaaacgcagtagtatcactattgtcatcttcgatcctaaacaagtgttaaaaattaaaagctattggaatgaaaggttgcttgaggagatcaccaatcaatatcatgcgaaaacagtaaagctcacggagcaaatgagaatgaatgcaaatccagacacactaaagtggattaaccattttgtctcaaaacaattgctccctctgccgcaagaaaataatgataccttccaactcaaaatctttgaggaccatgccgactttaaagctgcaattgaaaaaaagaataatgaagtaggtctatcacgtattgtctcgacctttgactatatccataaaaaagatggtgctacttatatggtcgatgaggaaggcattaacatgccatggaattctacaaatgacaaatggacttgggcagaacatgcagattctattaaagaggttggttcaatctatactgttcaaggttttgacctaaattatgttggcgtcattctaggaccttctgtcagctataatagtgaaaaggatgagcttttcatcgacactgcaaaatataaagatacaggcgcattcaccaaacgagatgacatgtctgccgagaaaattaagaaaataaaggaagagattattctaaactctatcaacgtcctcatgaaaagaggcatcaacggtctttacatttacgcaacggatgtaaaattaagaaatagattgctagagttaaaaaggagaaggaaaaaatgagcgaaatcaaagatttaattaacacgattaatgaatttagagacgcacgcaactggagacaataccacaacccaaaggatcttgccatctctatttcaattgaagcggccgagctgttagaagacttccaatggaaaagcagcgaagaagcactcaaagcaaacgaggaaaacattcgtgaagaaattgctgatgttcttatctattcgctgatgctttgttcagatcttaagatggatgtgaaagagattattgaggagaaggttgtgaagaacggtcggaagtatccggttcaagggtaattatatttcttacaataattaaagcaatcttcactcctcaaaaaataaaagtgcatgacgatatatttttggaatgattaacaaatagattgattcttctgaatatattgtagctcaacttaccgctgagtgacagaaattaatcatagatactgagtttaaaatttactttggatttactaatgtaaattattaaacttaggattttattaaaacaggcatattcaagtatgcctgtttactactttaagaaagaagtaacctcattcacttatggtaaggctctccgtagtgtatctacttttgttctagttcttttaaaacctttaagtcttcataataccttaacaccgtactttgcattactaactttctattggcagaatctctaatgttacgaaatttctcattataaaacagagtaaaatcatgtattgtgctaaataaggttatgttagcttgtacccattctgataatgtctcatcagaaaaaggtaagtcatttgattcaaaaaataaactatccaacactgacgaataaggtgttacacttgcaaataactcatcttcaaaaatagtctcattttgatactcattaaataatgaaattatagattcagcatatgttatcatttgatacctaatttctttaactttatatagtacttcatcgttaggcttggtattatcaaaaataaaattactaattatcttatattggggataaaactcaaaatgaacaccttttattaaatgtttattagagcctttcaaactataccaataagtcttatcttgattatcgcttacccaagtagttttacaataataatttcctcgtaaaatatcactttcataaaaagtgaaataaatccatattatatctgatggacagcctttatatctatcttcttgtattttgttattatatacatcgcaaaacagtaatctttttttaatttttgttgagacgtctgctatttctgcatccgagaatggtttcttaagaagtatttttgccgcgtacctttttttagaaccatgatggacaggttccacactcttaatgatgtaatcctcgttttcaaggtaaatattatcttttttataaggagtatactctgaaattttaaaataaattgtacctcctatattagctctatatatagcatgctgaggtgtatccggattatttaaagtatgaatctcaagtaacctctttacccacaactgcaaatcataaagtgaaatttctcccttttttattaaaaatttattcgtcagtccatcgcataaaatatttgtaaatatacttccattgctccctccataagaaggttcaatagcgttactaccacttaatatcgcataaccgctaccttgaaaagattctatagattcttctaaattagtgctttttgtaccttcaactctaaaattacctgaatagcagcagtctataagcaatactttgcttttagctaatgactcgcctattttattaattatgtcctgagtacataataaaccatcgctaaaaacaatattatgaatttcactagaagtcccatgacctgagaaataaaaaataaatatatcatctttttgtaaattgccaataaaaagctcaagggcatgtacaaaatcgacgattgctacatgaccgttatttgtcatacccatttgaaaaatatccatatcatccagctgtaatccttctcttaacgctttattaacattaattatgtctgttttacaaaatggtaaatcaggtgcaccgatacctgaataatcactaactcctactataaatgcctttatccttcccatataaatcaccccagcttcacttgtttatctgattaagattgtaataatcatataaatagacaagcccaatttttattaaagaaaattgggcttgtctatattattctggttgttctaatcgtgattgaatgtttttccagtgtttcttcacttgtgtttccataagatttatagtttttgaatcttcatcaaatatcttctgtgctctttcaacgtaactaataaaattcccatgccctttcttactttttcccaagtgagagtagttcttatataattctctcctatacgatttacgaccgaatttttttgatttacgattgcatatccttactttacgatatgctctcgtataatacttaaaaagacttttttctctaattcgaacttctttaccattaaaactgaaccctagatagtctaatattgtctcatttaagtctaaatcgataatctgattatcgttataaaaataattccctgtcttctcaagttgaatttctaaatttggaatctgttcttttatatcttccaaaattttttgatgaatttgatagttatagtcttgaatgcctccttcaataggaataactataattaaatcatcacaatatcttctatatagcccattttgttctttaacatatttttgtatttttttatcaaagtccagcaaataaatattagaacagactgaactgatacccgctccttgaggaattccataccttttagaattcttgtaaatatttttatgcttaaatgctctaaattccttctctgtgaaatatttataactactttcaatttcactttcagtgtattttgtctttaattctgcttctatagtatctttaataaagtaactaaatcttgttatattcttgaagacattataataatcgtcaggtaaggtatccttttttagaacatagcggattttctctttaagatacctatgatccaatgtatcaaagaaattagtaaagtcagcaacaaaaatatatgcactttgctgcacttttataaaatcaataacttctttagcgaagttaatattactttttccagataagttattccgatatgcagttgcaacttcattaatacctagttcatctacaacagaattatagtggttatttagcttgtccccatagtacttatagatatagctatccatatgagacgcatagaaaattttacgaactttttcttttcgctttttttcttttctgctatatttttgaaatttaatttcaaaatgcataaacgggtaaaaaccatgtttagcaacccatcgagggttctggattttactcttaactttttcaattgattttttattatcaaggtgcttataaccctttacacgatactttttttcattcatatttggcagagctagcaggggtatgtaatcgtagcctattactctctatcaaaaaccctgctagcatactctcctttcgaattatagaccattgctagcctataaagaggctactgaatgcactaatagcttatactataatcagtatattaaattggttgtttatgacgattggaggtatccaaatgccaagttattcagaagcgttatcgattgtaatcgactggataagtattatgattacaattgagataaagcttgacagaaattcaccaatttccctcataactacttttatgaggcgttaaccatattaatattaccatctaaaatttaaatagtcaaaaaagtcaatcaaaagtcatgttttgacctaagatctgaaattaggtatcttgaaaaatataaaatatattatgtaaatatatgagttttttatttttagaagtcgatgatcttcaactgatttgggattcaattaatgatactcaactagttttccacccaatataggcatcaaccggatcgattgattatctgaaattagaacattttacgtaggaaaaagaagtttctttaattcttgatagaaacctttttagtagtttattgtctcttgctaaaaatggtgatctaaaagacactacggaaaaaagaatgattgcttttttaatgttatgggctcaattgaatggaggttccaatcagtgctggattagcaataatggaaaatgcatcaagatacaacgattcttgcaatgctaaaatagagctaaataattttaatgatattttcgatttttatccacctcagatttggttaaatttagctcgtggcacaatagaccagattccaaagtgtaactttttcaatattccatatgaaaactcaatcacttatcatgacactaatgatcacttcctaatgaattatgccagcatgttgcatttagttaatatatatcgagactctgacatggctcctttagaaaaattattagaagtcctaagttggaactttgacaatttactcatctctcaatatatcaatagatatcttgttatgttattttccaatcaaaatggtatcaaagcacctaaacacgctaatagcgatttattagaaagaattgaaaaaggttgtatgaatcaagcatgggatttaacctatctatcatgttggagtacactttactggaatgaatcaaaaacgcatgaggtttttttatttgctaccgccgataatctgttaaagaaaatttttattaacacacataatggtagagatttatttaatttaattaatattgcttttcctaaaagaagtgctgataaaatcattcaattctatattgaaaaaacaagaaacagaattttggggataatccaactcaatatttcaaatctttaattgagaaagaaaaaaagcatttgaaacaatctgtgggttgataattttcagctgtattacctaatgtcattccctttgttgtaaattcaaatatacaatacaaactttaatataaccaaaacagtccctcccccatttgttggggaagggactgttttggtatacaggtaaaatctcatctacttatgatacggctccccacgattaatccgaaaagcccgataaatctgctcaactagtatgagacgcatcaactgatgaggaaacgtcatttttgagaacgacagcttctcgtccgctcgcttcatcaccgcgtcgctcaatccgagtgatccgccgatgacgaaggtgactttgctttttccatatgtagccagcttatctattgtatcggctagttcttcggatgttttcatttttccttcgatggcgagggcgatgacgtggacgtcggggctgattttggataggatgcggtcgccttctttgtcttttatgattttcatgtcctggtcgcttaggttttccggcgctttttcgtccgggagttcgatgatgtcgatttttgcgtaggccgaaagtcgtttggtgtattcttcaatgccttgcttgaggtatttttcttttagttttccgattgtcacaatattgatattcacaggtcatccccactttaaaaacaagttattcatatatgttgtccacaattgtggatatcttttctgtattttgtgtaagatcattcgttccccactatatatactgcggggtctccacataattcacaggctgtggataaactgttagtatgttcgatttttctgatttcgggcggcagctcgtggtcgtctatgtacatatccagcaccgtttcgatgtgttcttcacaagaataatacgcttgtttcatgttcaaatcctccgatgttttcttccatttttacaaatgttctcttctcaatataacctatttattcacatgttagtagtgcttcgggctgagttttatccacaattcgacaaacaagctgttgatgactctatttcgctcgtgtgttagtttggatgtaaccgatgtgtgaggaggtctacatttgcgctttagatgggtttggctttttgtgatcatgttgctgcttgctgggtgtcagccgtcttattgggtgttggagaaggatcgaatcggtgaaggcagtccagacttagaaatatacgctaattaccttcaaatgcatgatgatgtaaaaggatatcaagtcttcaccatatcagaaggcaaaaaaatggtcgtcgtgtctctcggaagcagcgagaacgaaaaacagcttgaggtgtcagacgtcaaattctcacctaaagaaacgattgtaactgtgaaacgaaaacctgcttccaaagctaatgagaaaaacccttatattctgattggactcgataaaatcgaaggggatttaattgtccaagacgaaacaggatatcactttgaagaaacagattaccagcaataaagccggcgttctgagaacgtccggctttttcttttacttcaatgtcccatgcgggtcgatgacgaattttttggctgcgcctttgtcgaagtcgctgtagccttttggcgcgtcgtccagagaaatgacggtggcgttgacggcttttgcgatttgcgctctgccgctcaggattgctttcatcaaattgcggttgtatgtcatggcgggtgtttgtcctgtgacgaaggtatgggctttagcccagccgagtccgaagcggatttttagtgagcctgttttagcgtcggcatcctttgcaccgggatcttcggtcacgtataagcctggaatgccaaggctgcctccgacctgggtgacatccatgatcgagttcagcacggcggcgggcgcttctccttgattgccgtgcccagatgcttcaaagccaacacagtccactgcggcatcaacggttggttcacctagtatttgttcaatttgttcgccaaggcggtcgtgtttttgcacgttgaccgtttcacagccgaagcttctcgcctgtgccagtctgtcttcgttcagatcgccgacaatcacggtggaggcgcctaggagctgagcggagtgtgcagctgccaagccgacaggccccgctcccgcgatgtaaacggttgaacctgtttgcacgccagctgtgtaagctccatggaagcctgtcgggaaaatgtcggacagcatggtcaaatcgagaatcttttctagcgcctgttctttatcagggaatactaaaagctgaaaatcagcgtacggcaccatgacgtattcagactggccgccgacccagccgcccatatcgacgtagccgtaagccgatcccggccggtccggattgacattcaggcacacatgcgttttctgcgttttgcacatcacacagcgtccgcaggcaatattgaaaggaacggatacgatatcgccctttttgataaattcaacatcacgccccgtttcaatgacttctcccgtaatttcatgcccaagcaccaagccttctggcgccgttgtgcggcctctgaccatatgctggtcgcttccgcaaatgttggttgtaatgactttgagaataaccccatgctcacattttcgattcacattcgcctttgggacgccgggcccgtccctcaagattaactccggataaccgatatcctccaccgctacagtccctttgcctttgtacacaaccgctttgtttcctgtcaacgccattcctccctttcatgtgtttggacgcttggtccttgaacatgacttcggtttggcatgaccctttccctttctcacgactgttttttctgtattcttataacaacaaatatgccaagaaagcagccaataatggttccgccgatgtctaagaagtcgactttacatccatttaacaggaatacagtaatggccgaaaccaggctgatcataactgccagaagaataacccgtttggtgcgcatgtaattcctcctttagattcgtttctaaaccatacccaaaatcctctgcaaatttcggttcaacaaaaaaagagacttcacaccagtctcttcataattagagatcaattaaaaaatttcctgagaaataatgtgacaatactggttaccaacgcaatcgccgtatacataacaacccaaaacatgaatgagctattacccgaagctaacgtaaataacaatatcaagctcgcgataaggacgatgagcggtgccacccaaaatcttttaaataaaaaatgaccggctataccaaatacacctgcaatgatcggaaaaccaaaaacgataaataaaacggcgatagctcccatactaacctccttgccctaaaaccccttcatcacctcaacatcatacagcttcaaatgactcttcggcgtcacgacatcctttaccttcccaatctctttttctttcattttctttccggttttcagactgtactgttcaatgtaggcaggcttgttatacgtgtatgtgaagtaatagaggctgctgcctttttgggtgatttctttgaaatcggctttcattttgtcctgggaaagggtgaaggcgatgtttgtttttcctgtcttggcatcgattttgtgtacctttccgaagccgtcaatgaaatacaggttcccgtcataagggaaaaagctgtttttaaagctgaagggcatggagctgtatatcgtttgttcgtcgtttttgtattcggcgatgtcgtgcagctctactttgccgctttttttgttgatcttgaccatttgatagagattgcgggctttttggccgcgaaccataacataaacagcttggtcgtccacagcaagctgggattcgactgaggctccttcccggtactgccattccgatatcttgtggtaagtgagcttcttttgatctgcttgaatctgaaggagctcatagcctttttcgtcagctgtcgggacaagtgcgtaaatggcgccatcatggaaaccggaggctcggatgtagtaggggatgacgtcttttttccactctccgtctatttggcggtacagctctgagcggtatccgtctttctttttgtcgtagccggagttgtataaggtgtaaaagccgtccgtgttttgcagaaagcctgcgctgtcgcctgtgtgctgataggttcttttatgagatctcaggccgtctttaatcgtataaatcttgtttttgtcctccagcatcacactgtcgccgtgaaccttggctgatcccagctcaaggcccttcatctgaaatgaagacagcgacccgtcctggctgataaacaaggcatagcttttcccaccgccaaatgcatcttgatccgcagaggttgaaaaatataacaggacttctttgtcatccaagaaaccggagtctcgaagatcctggtgacttacagttttatggctaggagaaatgaagacaaatagtgcgattcctgcgagaatcagcatggcgatggtaatcatccactttttcatatccttctccttagtaaatggtcatgatggttgtcgtatacgaagaacttgtgatgtcgcgcggatacacgcctaagcctccgttgctgtctatatcaatccctgcttttagcaaaaaggcagaccataggagctttgaacagtttttggcgccgtcatggcccgtatttctgttattgacgaagttaaatgagtatgggtcgccgacttttgataccgcccagtcggcagcagctgttttttgagatgaggatacgctgacggtttgcacaatggagttgtcttccacgtctctggcattatacgcgatctgcctgacgccgtcgctcgggacagattcaacaattttgtcagcggcggagtacatgccgacgtggccatgattgtagtaggctgtgtaggagttcgtgtaatagatattgcctttcgcgcttgtcgggagttttttcgtgccggacgacccgcccatgatagacatgccgctttccttggcgagccggtctccttctgctttatcagccgtgatttccttatagaactgttttaggataacgtcctgctttacgtgctgctgtttggcaatctggctggcagatttcatgatttcttccggtgtcgtgcctggctgcagtgcggcgatttcttcagcataatttgtgttctttacggctttggcgggagaaacgaacaggccgccacacattgtaagcgctaccaaaaacatcgacactcgtttcttcaacttcattacatctcctcttttcttgtgagtgtaggaaagggaatttcctcacccacattatattaggaaaataaggaaagtaactaggttatttacagaatttttagaaatcgtttacagaaaaaggcctttatcaggcccttttcgttaaatcttcttgctcatcactacgtctgtttcttgaaatccggtttgctcatatagctttcgcgccgtctgattatgggcaaagacatgaagggacagcttgcggattcccatgctgcgtgccgtttgatctaatgccgccaatgcttgctttgcgtagccctttccccgatacggttcatataacccgaaatcataaataaacgcttcctgctgcggatgctccggttcagcatgtatccagagccagccaacgatatccttttcattcagcttgaggctccacaaatggtgatggggtgtttccagccctctcggaagcagatcagtaaacgcctgcttagacaaaagctgtgcatcttcaggcagccatgttcccgcttttaccttttcttccgcgtaatgctttgttgtgtacgtgagataagaccgaaattcttctgtctgcattggggtcagcatgattgtcatatcatctctccttcatatattgactagaggattttacataaaatagaaagaggtgttactatcagaataagcaactgagattgataagtcactagagaaaggagtttcacatgaataagatcgcacccgcagaaatcgctagcatgctcaacgattggtaccttgccatcaagaaacatgaagttgaagaatcctcccgtttatttgaagaagtgaagcctttattggacgacatggaagaggatcaggaggtgctggcctacttctccttattggaactgcgccacaaggttttgcttcacgaggcgagaggacagggctttcagcatgaggagccttctcatatgaatgctacgtctgacatgctgaaatattacttttttctgtttgaaggcatgtatgaggcctataaaaataattatgacattgccattgggctgtataaagatgcagagcagtatctcgacaacattcccgatccgattgaaaaagccgaatttcacctgaaggtcggaaagctctattataagctgggacaaaatattgtatccctcaatcatacacggcaagcggtcaaaacgttcagggaagaaactgattataaaaagaagctggcttcagccctgattaccatgtcaggcaattttacagagatgagccagtttgaagaagctgaggcttacttggacgaagcaattcggatcacgagtgaattagaggatcatttttttgaagcccagcttttgcataacttcggccttcttcatgcgcaaagcggcaaatcagaagaagcggtttcgaaattagaagaggccttacagaacgaagagtatgcccgctccgcctattattatcattctgcctacctgctgatacgagagctgtttaagatcaaaaagaaagaacaggccttatcttattaccaagacgtgaaggaaaaattgactgctgagccgaatagaatatgtgaggcaaaaatagacattttatatgccatttatgcagaaggaggtcatgcggaaacgtttcacttatgcaaacaacatatggatgacttgttgtccgagaaagagtatgacagtgtaagagaactttccattttggctggcgaacggtatagggaacttgagctttacaaagaagctgcccactttttttatgaagcattacagattgaagaactgattaaacgaacggaggttatataaatgaaaagatttctgattggcgcaggcgtcgcagcggtaattttatcaggttggtttattgcagaccatcaaacccattcacaggaaatgaaagtcgctgagaaaatgattggataaatgaaaaacccccgcgggtgcgggggttcaatttaacgaaagaatcctaaaacggtttgtagttttaggattctttcatcttttcagcgtgattgaaaacccttgaagtctaggaagaacgagcattggagcgcagcgaatgtttggaattcgtgagcaccgaagcgcaggcctgacaacgaatgcgagggtttgtcgacacgctgaaacccccgcgggtgcgggggttttcttattacagcagcttcttccctagcagagattctacgagctctactgctgttttacccgttttgtttttgtgatcaaggatcgggttaacctcaacgaattcggctgaggtaatgatgcctgcgtcatacagcatttccatagccaaatggctctcccggtagctgatgccgccgacgacaggggttccgacacccggtgcgtcgttcggatcaagtccgtccagatcaaggctcagatggacgccatcacatgctgataaataatcaagggtttcttcaatgacctttgtcatgccaagacggtcgatttcgtgcattgtgtacaccttcatgccgctttccttaatgtacttgcgctccccttcatcaagtgaccgggcgccaatgatgacgacgttttccggtttgattttaggcgcgtagccttcaaggttaaccagtgactcgtggccaatgccgaggctgaccgcgagcggcatgccgtgaatattgcccgatggtgaagtttcaagtgtattcaaatcgccgtgcgcgtcataccagatgacgccgagattatcgtaatgcttcgctgtgcctgcaagcgtgccgatcgcaatactgtggtcaccgcccaggacaagcgggaattttttctcttcaatgactttgttgaccttttgcgcgagtttttcatttcccgccaaaacggaattcaggtttttcagttcctcgtcatttttgattttttcgcggttgatcggaatgtcaccgagatcctcaaccgtataccccatgtctgacagccgctcgatcagatgagcgtaccggatggcactcgggcccatatctactccgcgtcgtgcttgtcctaaatccattggcattccaataaccgaaatcgttttatccatctgtgattccacctcaacatttaagataatgtcctatgcgggttctaacaaagatgacttacggacaacgttttaaagctctagctgacgattcgcctgctggcgttttttaatgacgacatgataaatgatgtagcaaatgatcataaacggtacgccgcaatacagcgcgatacgctgctccggatcaaatgcgagactgatgagcacgaccgtatttaacgttagaccgatcagcggaagcaccgggtacagcggtgttttaaatttcaaatcttctatcttcccgccttcgcggatatatttgcgtctgaacatgatttgggaaagcgaaatcgtaatccagccgacctgtgcgctcatacccgccaaagataacagtaccatatagacagtttcagcctgcgcaaactttgtcagaagtgataggcaggccacagccatcgttacgattaacgagtacatcggtacaccgcgctgatttgtttttccgagcgctttgaaggcctgtccttcattggccattgcgtacagaatacgcgttgatgcgtataaacctgagttcgcaacagataacagtgcgattaaaataacaaagttcatgatatcagctgcatatgggattccgatttgctcaaatacggcaacaaatggactttccacgacacccgcctgtttccacggaatcatgccggcaatgacaatgattgaaagcacaaagaagacaagcgttctccatactgtctgtttgattgaccgtggaatcgttttttcagggtcttcactttctccggctgcaaccccgatcagctcagtcccctgaaacgcaaagttcacagtaatcatcgtaatcagcattgcctttatgccgttcggaaataacccgtcttcataaaaatgtgtcaaaaacggcgcctgctctccgcccttcagatcaatcaggccaaacatggcagctccgccgagaataataaataaaaggataatcaaaattttaatgcctgaaaaccagaattctgattctgcaaaggcttttgtggtgattgcatttaaaataaacatcagtgccgcaaagaccagacaccaaatccacacgtctatatgcggaaaccagcgttgcatcagctgccccgctgataaaaattcaatggcgcatgtaaccgcccagccgagccagtacagccagccgaacgcaaacccgaaggccgggctgataaattttgtcgcataggtctggaaggatcccgacacaggaaaggcgactgccagctctcctaagcagagcatcgtcaaaaacatgataaagccgcccactaaataggacagaaccgcgccgagcggtcccgcttggttaatggtaaacccggttccaaggaagaaaccggttccgatcactccgcccaatgaaatcatgaacaagtggcgcgatttcattgtccgctggagctgatttccgttatcttggtttgtattcacattctgcaccccttcagcaacttgtattggatctaagctggaacatctgcatggtgctatcccagtttgctgtccaaagagcctctatctatttaatataaaattcacttcttctcataaagatacattatactaaaatactgtagctgagcaaatagggagtgctgatttttctgttgtaaatttatacaaacgaagtgaatatcccgccatggtgcggatttatgcgttttgcagcacgtgcttaattttctctatcgcccaatccaaatcctctttggaaatgattaatggcggtgcaaaacgaatgactgtatcatgcgtttccttgcataaaagcccttcttccttcaaacgctcacaatacggacgtgccgcttcagtcaattccacaccgataaacagccctctgccgcgaacttctttaataaccgggttgtcaatgctctcaagctcgcttttaaagtattcgccaagctcaagagaacgatccgccagcttttcatcctccagcacttctaatgaagcgatagacactgcacatgcaagcgggtttccgccaaatgttgagccgtgtgagccagggttaaacacgcctaggatctcgcggtccgccgcaatgcatgagatcgggaacacaccgccgccaagcgctttgcccaagatatacatatccggaacaatgccgtcccagtcacaggcaaatgtcttgcctgtacgtccgagacccgtttgaatttcatccgcaataaacaagacattctcttccttacaaatcgccgccgcttcctgtaaaaatccttccggcggaatcacaatgcccgcttcgccttgaatcggttcaaacaagaatgccgctgtattcggcgtaatggcctgtcgaagcgcttccacatcgccgtaaggaatgagtttgattcccggaagcatcgggccgaatcctcgtttatattcctcttcagaagagagagataccgccagcatcgtgcggccgtggaagttcccgacacatgcgataatttccgcttgattgtcagctacgcccttcacttcatacgcccagcgtctcgccgctttcaccgcagattcaaccgcttcggctcctgtattcatcggcagaatcatctctttgcctgtcagtttggctgttttttcgtaaaacggcccaagctgatcgttatgaaacgcgcgtgacgtgagggtgattttatcagcctgatcctttaatgcctgaatgattttcgggtgtctgtgcccctggtttaccgcagaataagcactcagcatatccatatattcattgccttccgggtcctttacccaagcacccagcgcttcagaaataacaatcgggagcggatgataattgttggctccgtaatgagacgtctgatcaataatttctttggatttagataaagctggcatatttgaattcccccttgttttctgtttcaacatgttatcctgctttccctttatataaatgcaagttctgtgccaaatcaagaattcgtgtgttttctacaattttcgaggacaaggtgcaaaaacattctgatatttcgagcaaaaatttcagcaagtgcaaaattcttttgcataccctctccatttttttataaaatagaagcaatattaagaaaactgagggaggttcatacagtggtcaaagacagcgaattcctcacattggtttttcagagcattttagatgaaatcgatgttggcctgcacgtggtagacgagcatggaaacacaatcgtatataacaataaaatgatgcagattgaagatatggagaagcatgacgtcttgaataaaaacctgatggatgtgtttatgttttcaaagcagcaggacagcacactggtacaggctcttcaggaaggaaagacgattaaaaacgtcaaacagagctatttcaataataaaggccaggaaattacgacgatcaatcatacatatcccatcgtccaagacggcaaaatcaggggcgccgttgaaattgccaaggatgtgacaaagcttgaacggctgatcagggagaatatgaacaaaaaaggcagcacaacctatacgtttgacagtattctcggcaccagtccggccattcaagacgtcatcgaaaacgccaagcgggcaacccgtacgtcatcatctgtccttctcgcaggcgaaaccggcacaggaaaagaactgttcgcgcaaagtatccataatggaagcgatcgttctggcggcccgtttatttcgcaaaactgtgcggcattgccagacagccttgtggaaagcattttgtttgggacgaaaaaaggcgcgtttaccggcgctgtcgaccagcccggcctgtttgaacaagcccacggcgggacgctgctgttagatgaaatcaactcgctgaatctcagccttcaggcgaagctgctgcgcgcccttcaagaacggaaaatcaggcgcatcggttcgacaaaggatacaccgattgacgtacgtattattgccacgatgaatgaagacccaattgatgcaattgcaggcgaacgaatgcggaaggacttgtattacaggctgagtgtcgtcacactgatcatcccgccgctacgggagcgaaaagaagacattttgcttctcgcgtcggagttcatccagaaaaacaaccatctgttccaaatgaatgttgaacacatcagcgatgacgtgaagcaatttttcctttcttatgactggccgggaaatattcgcgagcttgagcatatgatcgaaggcgcaatgaatttcatgacggacgagcaaacgattacggcttcccatctgccctatcaataccgaatgaaaatcaagccggctgacattccagagcctgaaacaccaagacaccagccggccgcggacttaaaagaaaaaatggaaagcttcgaaaaatatgtgatagagaatgtgttaagaaaacacggccataacatctcgaaagctgctcaggagcttggcatcagcagacaaagcctccaatatcggctgaagaaattttctcactcgtctaacgaataatccggagcaggaagcctgatcagaaaaacagtgcctctgccgatttcacttttcacttcaatcgtcccattgtgattgtcgataatcgatttcgttatggcaaggcctaatcccgaacctccatatttccgggagcgggatgggtctgccctgtaaaatcggttaaataaatgcggcaaatgctccggcgcgatgcctgtgccattgtctgctatcatcagcatcacgccggaactgcctttttgcagagaaatagtgatggcaccggttctctcatttgtatactgcaccgcgttataaaccaaattcagaatgacctgtttcatcttatcccggtcaaacaccgctttagcatcatcctcaagcagcagctgcagccttctttcttttgcaagcagactgagctgcggctccatttcccttatgagcgcatcgagatttcctctcttcatttcaaagctcggcacccgatcaatttttgctaaaaacaacagatcctctatcagccgagtggctctcttcgactcttcatacatactattcagcgccctatctctctgctccggctgaagcgcggcgccacgcagcagcacttcgataaagccgtgtatggacgttaaaggcgttctcaattcatgtgaagcgtctgatacaaattgccggatgcgctccttcgcctctttttctgctttaaatgacgtttcaatccgctccagcatgcgattaaacgaaatagcgagcgtgtcgatttccatttgttttcgatatacaggaagccttttattcaaatttcctgcattgatttctcccatcatatgtaccatttgtgataacggtttaagcgtatgtctgaccacaggcaagaacgtgaaaagcccgagcaggagcgcaaccagcgagagcgtggaataaatgctgatttgccggagcagtacgtccttcagtggttctgttaaagtactcatttggatcacgcctgcttcttttccatcaatagtaatagcctgaaacacaatcagcacttcctcgccggattcatttttcgtgattttgtaatgcaaggccatcgtatcttttaatgcctcatcatatacactttttttcactgttggcggtgctcccgcatatggatcggtcgacaataccgtactgtcttttgttttcttatcgataaaaacaatggtcacgcccggatagataaaggcgggacggacagcaccatctgacttttccgagctgtcgggatggcttttgtatgttttaatattattccagatggttggctccgttgagttgatataactttgaatgctgacagctcggttttcatataagaggcgttttccaaacacatattgcatagcgccgacaaacaccaatagaagaacgagaatgcataatgaacggaataaaagctgaaagcgcagtgttttgaatcgttttttcattcaatatccacccgatagcccgcaccccgaaccgttcggatcacttcatgctttttgtcattcaatttttcccgcaaggaacgaatgtacacttcaacaatattctcttctccgtaaaaatcatacccccatactttatccagaatccttgctttactgagcacaaggccgtgattcagcaccaaaaactttaaaagctcgtattctgttgctgaaagcttgagcacctcttcctgatagcggatttctctgcgccgatcatcaattcgaaacggaccgagcgcgaattcttcaaacaggttgggaaagtgatcccgaattctcgcatagattcgcgccagcagctcttcaaagctgaagggtttgatcatataatcatcagcgccctctgtcagcgcttttacccgaacccccacctcatccttggccgtaagcataataaccgcggtatggccggtttttttcatcatcctcgatacttccagtccatccattccgggcatcatcacatccaagatggccacatgcggctgaaatgtctttacggtgttcatcgctgtcattccgtcagctgctgtcttcacttcaaagccttcattttcaagacccattgtcaaaaaatctaatatcgccggttcatcgtccacgagcaaaatcttgatgcctttcatcctattcatgctgtgctctctccttagttggcataaacctctgattagttttttcccttcccctcctattattcgtttttacctgaaaacaaactgaatcttccctaaaaatcagctgaattcagcaagttttcagccagccctcatttgattttcagcttcggcctatacaattgccttagttggtacagccaacaatgaaataaaggaggaatctcacatgaatatcactaaagttttatcaggagctgcactgggaacgattatttcaatcagttctttcacttctgctcacgccgctgtcattcaaaaggatgatacatcaacgaaggttgagacgaagcaacaggcttccatcacaatagcaaaggcaaaacaggttgctttgaacaaatgcaaaggtactgttcaatcagcccaaatgaagaaagtgaatggcacatacgtatatgttgtgaaagttctcggtgaggacgacaaacagcatacgatgaacgtcaactgcaacagcggcaaagttgtgaaacatgatgttcaaaagaaacaaagctatatcagcaaaacaaaagcccaatcgatcgctttgaaaaactgcaaaggtgcggttcaatcttctgagctgaagcaagaaaacggtgtttacgtttacgtcgtaaaagtaatgggtgaagacggaagccttcacacgttccatatcaatggagaaaacagcaaagtcgcaaaacacgagcaaaagaagcaagcacatctttctaaaacaaaagcgcatcaaatcgcactcaacaaatgcaaaggcgcagttcaatcttctgaactgaagaaagaaaacggcgcatacatctacgttgtcaaagtgcttggcgaagatggaagcactcatataatccatgtcaactgtgacagtggtaaaatcgtaaaacaagaagtgcaaaagaaaaacgcagccgttacaaaaacaaaagcacatcaaattgcactaaataaatgcaaaggcacagtgaaatctactgatttgaagaaagaaaacggcacattcgtttacgtgattaaaatcactgcccaaaaccacactgaacaaacagtgaaagtgaatgctgaaaacggaagcatttgcaaataaaataaactgcctgccagcagtaaaataactgaaattcaacgtataacaccagtcttgttttaacacaaagttctaagttcatgtctacctttttctaaatactcttttaaactgaacgtgcgtgacccgcgttcagttctttttctaaggaggacctacaaatgaatatgaaaatatgttctgcagctgctttaggagcgatcatttcaatcagttctttatcatccgcacacgcggctgttctgcataaagaagacactgctaaagttcaaacccagcagcaggcttctattacgctctctaaagcaaaaactgtcgctttaaagaactgcaaaggcgcagttcaatcagcacaaatgaagaaagcagatggcgtttatgtctatgtcattaaagtgcttggtgaggatggcaaaattcacacctttaacattaaccgcaacagcggaaaaatcgtcaagcatcacgttgaacataaacaagccgcgatcacaaaagcaaaagcacaaagcattgcgttgaacaaatgcaaaggtactgtcacatcttctgcattaaagaaagaaaatggcacctatgtgtacatcatcaccatcacagccagcaaccacacggtacaaaccattaaagtgaatgctgagaatggaggtatttgcagttaacagccatttgctgctgtttcacgtgtaacatccatcttgtatttttcttcatattcgatatatccttttcaactgaacgggcgtgacccccgttcagtttttttgcatatcaaaacagcctggcaaacgatgccagactgttttgattaacttcctaattggtctgcggaggacagcttgatgtctacagatttttcttttccgccgcggtaaaacttcaccttcacccggtcaccgacttttttctgataaagccgttttcgcaggtcaacaatatcatttactttgtatccgtcaaatcccgtgatgacatccagttccttcagccccgcttttccggcaggtgaaaaggcgtctacacccatcacaaccgctccattggtaacatgcttaggaagctttaatgtttcatcccaatgatagcttgcgatgtcgcttagcgatttcatctcaatcccaaggaacgggcgtttgacctttccgtatctctctaaatcctctatcacagggatcacgagcttagatggaatcgacaggccaatcccttcaaccgccgactcggcaattttcattgaattgatgccaatgaccttcccatccatatttaacaaagcaccgccgctgttcccagggttaatggccgcatctgtttgcaggacttctgcgttccagtcaggctgtccatcaccgtttgaatctactgggatcgccctctccgtacccgagatgacgccttgtgtgacagagccagcaaactcaaggcctaacgggttcccgatcgcaataaccggctccccagacttcactttatctgaatttccgaaatcggcgactgctttaattttatcgcttttcacccgtaaaacggccagatccatcagctggtcgctgccgacaagatcagctgatacacgtgagccgtctttcaagctgatttcaatttgggaagcgccttcgatgacatgatggttggtcacgacataagcggaatggtcatttttcttatagatgacgccagagccgctcccagcctcgccgctctctccccgtatatctgatttttggatgttcacaacaccgacaacggcgggcgacacattgctgacaatcttggtgaccgtattgttgacactgacattcaccgtcctgattgattcccggccgttattgttctgctgctgatctaaagcgcccgtatctagcccttcatttgaaaggtacggcatgataaacgccattaatacggcaccgacaatcacgccaatcaggcttgaaagaaaatatccttttttgcttctctttggctgttcaggagtagtatgttcttcctcacgttcgtaatccaccatattccatcctttccaagaacgttaatatggttatattgtgggttagaagctcctagaatagtcatgatttacatagaaaaattatacagcgcaaagcggagtggccttcttcggatcagtgtcgtataagtcaaatgtctcacccgtcacaaatcctttagaagccaatgtctgctgcacggacattcttgccagctccttcatgttgttgtcctggctcaaatgcgccaggtaaatacgagacgtctcatcgccaatgacatccgtcatcgccaaggcagcatcttcatttgaaacgtgcccgacgtcacttaaaatccgccgcttaatgctccatgggtatcttcccatttgcagcataccgacatcgtgattgctttcaaacacaaacacattcgctgaacggataatgcctttcattcggtcgctgacatatcccgtatctgtcattaacgcgagctttcggccgttataatggaacacataaaacatcggttccgccgcatcgtgggagacgccaaacgattcaacatcaagtccgccgaacgacttcaccgtctccatcggaaatacaaacttttgatcggtgtcaattttgccgatttgattctccatcgctttccaagtcttctcattcgcatagatcggaagcttgtactttctggcgacgacaccaaggcccttaatatggtcactatgctcatgcgtcacaaaaatgccgtctacatcatccagcttacgcccgatctgcgccatcagcccatccatggcttttccgctcaaaccggcgtccactaaaaatgcgtgatcctctgtttcgaggtaaaacgcatttcccgtactcccgctcgcaagtacgctaaattgcaagctcatgtttgtctcactccattattttcattgatctgtatctaaaatcgtactctccaaagcattcacagtaaaatactcttgtactgtctttttctcaccgttcacttttttctcgtactcgaccgtaattctccataccggcgccagcacctgcgtacttgtcagtggatattgtgctacatagccgaatttacagctcttcacagtgctgtattcttttaattgattttgatagtacaatagctcaaccgcatccatttcagtaattaagctttctttctggatttgcttgaaggtctcaagcgttgtctggtcgtacgacacaacctcgtttttaccgtttaagtgcaataccacttgcccgatcatattagcgggattatcggtcttttggtaaatataatggccttcgtacgtttggaagaaaataatttctttcttcgatttattaaccttccaaagcttatatttttcgccatcttgaatctttgaagaaacaagtgcctgagcatcgtcctcgatatccttctttgatagggctattggatttgcaaacttcattttcaggctcgttactttatgatcatcactaggcatgtccatcaaaggcttttgatccttcagcgcctcaatttcctccttggtgaaggctttttgatttgccgtgatccgatagccttctgtcgcttccttattcaagccttcatacgtgatatgatcggccttcatgtcatgctcgacatcatttttaatgacttcatattctttgccggtagcctgccatttttgaaaaaactgatagcctaagaaaatatctaaaatgaggaaggcaacgatgaagattgattttgtcttattccactccactgttagccccctccttcctcaataaatcctttgtaatcggcacaatttttccatttactttcatcgcccaaaccggttccagttcaacgagaggatcatcgttggttgatgttgataccaattgataagcaaggaagatctgatcaattttgtccgtatcataagcggtttgtttcgaaagcagcatcctcacttcgctgccgctcatgagctctgtttcacttgttttaatcggattcgttccgagactgtaattcggccgcttatagctgagaatatcatcattcgcccattgcaccgtaatcgccgatgtcgccccgaaaggtttggtggtgctgttaatgaccgggatctgatccataaagatatagaaactcagctgctggctgtcattgatactgaaaaattgatagtgatccgtccagcttccggtatcctcaaggtatttttggctctttttgattaattcacctgtttgataggatgtgctctgcaccaaattgcgctgttgaaattgcacctgtcgctggcttagattcacatctaaacggctgatcccatctgtcagcacatttctgttgttgtaattcgaatcttctcttacaatgctcggatcactaaacaaagcctgcttaaaggtatttgttttaatcgattctgtgacaaattcttttttgtccatcgtaagcggtttgttcggcagcaagaactctttctttgagccaatggagaacaaactgaacgccggcatatttgattgcctgtttttcaagtcgttcataatgttccggtagtttgctgactcaaccgtcacttcaagaatgagctgtttgctgtaagacaccaaatagattttcttgttcgcttttgtttcattgaacgggatcagaatatggtcaaacgaactgtattcaaacgactgattagaccatttaaacagcgtttggaaaatatcaatcggaatcgtatcgctgaattgcaagtcaagcttggcttcagaaccgcctattccataaaaccagcttttgaatccagccttgtcatactgatccgaaatatctttaattcctttcacatcccaatgtggcaagtcagaccaaatttcttcatagagggcattgtcatccactttgtaatgagcgccgtcatcatggataaacatgtcccttggccttaccgtttcagacagcttttgagtggttttttcgattttatgtttcacacgaacagtagactctgttgaggatgagccttcagaaaagtttggctggaacgtccatatcccccatgtaaaaacaagactgatgacgacgagtaccgtaagtaatatcgtttttatattttcacgcttcatcccaatcatcctcttgttcctctttatatggaagagtaaatgtaatcgtcgtgccttttccttctatgctgtccgcccaaatatctccgccgtgcgcctgtaccatttccttggcaatcgccaatcccagaccggtgccgccaagttttctcgttctcgctttatccaccctgtagaagcggtcaaagactttttcgacatcttttttcggaatgccgatcccttcatccttcacgctgatatagagaagttcttcctcttcattgacatcaatcgagaacgtgacatgtccgccttccggtgaatattttaaagcgttagaaataatattatcgagcacctgcgtaattttatcctggtcgatctcgacgtacagatctctgtccggcagattgcggataaactccacatgctgctcttttgtcatttcaaaacggtcaataataagcgacataaaccggacaatctgaatccattcccggttaaattgataatccttactgtcaaatttcgacagctgaagcagatcattgacaagccggatcatacgctctgtttcattttgtgtcaccattaagaagcgcggagcaatgtctttattttcccacgcgccttcagctaacgcttctaaatagctgcgcattgtcgtaagcggcgtccgcagctcatgtgatacattcgcaacgaattctctgcgttcctgatccattttctcttgttcggttacatcgtaaatgacagcgattaaaccatcaattttgccgtgttccctttgaatcacagagaaattcacgcgaagcaccgttaattcatcatcgcgctcaatttcaagcagcatagaatcctgctgctccactaaatcttcaaaagtataattctcttgaagccccagcaaactcgtaatcggcatttctaaggctgtttcacgtgaaacgttcaacagctccagcgccgggctgtttaagagaataatcgctccatttcggtttgtagcgattacgccgtctgtcatataggcaatgacagaggctagctttctgcgttctccttcagtcatcgcctgggcatcttcaagctctctcgttaagtggttaaacgttgtggccagctgcccaatttcatcatgcccgtactttttaaccttcctcgagaaattccctttcgcaagctccatcgcctgctttcgcatatctgaaagcggatgggtaatggttcttgccagaaaaataccgagaagagccgtcaaaacaagtgccaaacctgtgccggacgccaatatcgtgttgatcgtcttcatttgattaaagacatcttccatactcgcgacaacatagatcgcgccgacaacctcttggttttcagtcatgacgggcttcgcggaaataagaactctgattttgcttttcgggtcataatattttcttaaatacgactgtttggtagaaaaaattcttttgaaaatcagatcggtcgtttgtttccctgccacttcctcaccatacggctttgaagaaccgaccacttcatagcttttatctacaaagctaatttcccgaacctcatcacttttcgtgaagtcattcaaaatacggctgacgtcatcctttatgacggtgctgtcgttatcgctcttatattcttgttcgatataataagaaaggttgtcgattcgctgattcagcgattgttcataagagctgatcagcgacttctctacctgattgacaaaatacacaccaatgatttgcatggcaatgataatcaaaagtacataaatcaaggtaatcttaaattggatcgaccgaaaaaaaccaaccttattcatatggtcattagtcctgttctgggtttctcaagtaataacctacaccgcggcgtgtgacgatccaatttggatggctcgggttgtcctcgattttttcacgaagccggcggactgttacgtcaaccgttctgacatcgccgaagtaatcatagccccaaacggtttgaagcaaatgttcacgagtcatcacttgtccgatatgttttgctaaataatgaagcaattcgaactcacgatgagtcaattcgattgtttcgtctcgttttgatacaacgtacgcgtcagggaagatgacgagagagccgatatgaatctcgttagaggaaggctcttcctccgcaggcgctgttgtcagctggcggcgcaggttcgcttttacacgtgccaagagctcgcgtgtgctgaatggttttgtgacatagtcatcagcaccgatttcaagcccgataaccttgtcaatttctgaatccttagccgtcagcataatgattggcatatcgtatttctttctgacttcacggcatacttcaacgccgtctttattcgggagcataatatctaaaagaattaaatcaggctgaagctcttctaccatttcaacggcttcgtttccgtcgtgggcacagtgcacttcatagccttcttttcttaagttaaattccaatatatctgcaatcggtttttcatcatctactacaaggatctttttatccatcattttgattttcctcctgccgaatgacttcatttcatctatataacattcgtttcatcacttatggcccatgtaaagaatgggtccttgtctattataacggtttaaggtcaaaagataaaaaaaataaaggtttagaaaaaaaacacatgtttcacctttatcgccagttgtttatctattgtcatgctggtcaactttttttaaaaaagataactttattgaaacctcccttcaccggagtgcgtctttatcaatgacgtcttcttctttgaaccggccgcagggccggttctccctttttcttctattataacactcctcatgtttgcctttttcctaaaagaaaaaacgcacctacgattgcagatgcgtttggtaagtggctcgggacggaatcgaaccgccgacacacggattttcagtccgttgctctaccaactgagctaccgagccaaatgttttatttttctctactaagtaaagtaaaatggcggtccggacgggactcgaacccgcgacctcctgcgtgacaggcaggcattctaaccaactgaactaccggaccttacagtaattgcccggagagctgtcgtgtcagctctcacagacaaataaggaatttagcaataacgctaaagtaaatcaatgacccgtacgggattcgaacccgtgttaccgccgtgaaagggcggtgtcttaaccgcttgaccaacgggccttcacgaaatggtgagccatgaaggactcgaaccttcgaccctctgattaaaagtcagatgctctaccaactgagctaatggctcttaaagatgtcggaatttctatagagcaaacgacttagatctagttctcatcttgtactctattgaagcagtttccgtaacaacgagatttataatatcacgaacaaatagaagtggcaataacttttttggttttttttcatatttttttctcagaccaacttatatgcagctttcaaacaaaaaacaagccccttatataggggcttgcagacatattctatttagttcgcacggtacacactgcgaaggacatttgtttgtgagcggtctggaccgacagagaaaatagaaagcggaatgcctgtcagctgagacacacgctcaagataatggcgcgcattctccggaagctcgctcaagctcttcgcacctgtaatatcctcagtccagcccggcatttcttcatataccggctcacattcagcaagtgccttaagacttgctgggaattcttcaatgatttcgcctttatagcggtacgccacacagattttcaacgtttcaattcctgttaggacgtcaattgagttcagagaaagatctgtaattccactcacacggcgggcgtggcggacaacaacgctgtcaaaccagccgacacggcgcgggcggcctgttgttgttccatattcgcgtccgacttcacggatttgatcgccgatttcatctttcagctcagtcgggaaaggaccgtcgccgacacgagtcgtatatgcttttgatacaccgacaacgtgcttgattttggtcgggccgacaccagaaccgatcgtgacaccgccggcaaccgggttagatgacgtaacaaacgggtatgttccttggtcgatatcgagcataaccccttgtgcgccttcaaataatacacggcgcccttcatcaagagcatcgtttaagacaacagatgtatcgcaaacatactttttaatctgctgtccgtactcataatattcgtctaagatatcctcaagtttaaacccttctgtctcgtacattttctcgagaagacggtttttttcttcaagattgcgctcaagcttttccgcaaacgcgtcacggtctaacagatccgcgatgcgaattccgatgcgggctgctttatccatgtaagcagggccgattccttttttcgttgtgccgatcttgttagcccctttacgctcttcttccacttcatccaatttcaaatgatacggcaaaatgacgtgagctctgttgctgattctcaggttatctgtactcacgttgcgctcatgaagatacgcaagctctgtgactaatgctttcggatctacaaccattccgtttccgattacacacgttttatccttatagaaaattccagacgggattaagtgaagcttatatgtgattccgtcaaacttgattgtatgccctgcgttatttccgccttgataacgggcgatcacttctgcattttctgataggaaatctgtaattttaccttttccttcatcgccccattgcgtacctactacaactactgaagacatgtccgtgcacctccgttaacctttcaaaacgattctattcaaacaaatcaagtttatcagtgaagaaacagaaagtcaattgtaaatccgaacattaaattattgtaaatctatattcgttcgctttcattcgttttataagcgttttctcacggttttgtcataaaaagcttgcgaaactttcatcctttagcataagaaagaatcacttgcctgatatcccttttgaattcataaaaacgacccgccagccgtccgggtcctctatcgtcactcccccattgctccagtacgggttctctgattcgacctcttgatagcccatgtgctttagctttgaagtgatcgctgccagttcatctgcattcggcacataaaaaacaagaaggctgtcgggatggggaacgggggcagtgcttccaccttcatactgggtgaattccaaatgataatcggcatgaggaaggccgaacatgacaccgtcatacccgttatgctgtgaaaattctcctattcgtttcaaacacagtccctcttcgtaaaaacgaataatctcatcaagctggcccgtaggacgcgcaattcggatttgtgctgcgtgaaaagacgaaaaacgtttttccatattgttaccatctcctttttgcaccattttattaaaacgctttcagattttcatccgctgagcgaacggtatttcttccatctttcgaatgaaaaaaaccccaagagcagctcttggggcttatgcgccgggcggaactcctgcgtcatcaaaacgccgttccaggttgacgaatttgttgtattcttttacgaacgcaagagacacggttcctaccgggccgttacgctgtttggcgataataatttcgataatatttttattctcggtttctttgtcatagtagtcatcacgataaaggaacgcgacaatatccgcgtcctgctcgatacttcctgattcccggatatcagacatcatcggacgtttatcctgacgctgctcaacacccctggaaagctgagaaagcgcgataacagggacttgcagctccctggcaatcgacttcagttcacgggaaatttcagatacttcctgctgacggttgtcctttgaacgaccgcttccctgaatcaattgcaggtaatcgatcaaaatcatgcccagcccgctttcctgcttcaagcggcggcacttggcacggatttcactcactcgaatacccggtgtatcgtcgatgtaaatcccgctgttcgacaggcttcccattgccatcgtcagcttgccccaatcctcttcggtcaggttacctgtacggagattctgggcattgatatttccctcggcacagagcatacgcataacgagctgctctgcacccatctcaagactgaaaattgctacgctctcatcggtctttgtcgccacgttttgtgcgatgttcagggcaaaggctgttttccctactgacggacgggcagccacaatgatcaagtcgttgcgctggaaacccgcagtcatccggtcaagctccgtaaaccctgttggaattcccgtgatatcaccttttcgattgtgaagctgttcgatattatcataggtctggacaaggacgtccttaatattttggaaggcactcgtgtttttgcgctgtgccacttccataatcgttttttccgcttcactgagtaaatcctcgacctcatcctcacgggtatacccgtcttgagcaatcgttgtcgcagttctgattaatcggcgaagaatcgatttttcctcaacgattttcgcgtaatattctatgttagccgctgtcggcaccgagtttgcgatatctgtcaaatatgaaatgccgcctacttcttccagcaggtctgtgttcgcaagctctgatgttactgtcaccagatcaaccggttcacctcggtcaccgagcaccagcatcgcattatagattttttggtgggacattctatagaaatcatctggaatcaatacttctgaagccagtgttaaagcagacggctgtaaaaaaatagcgcctaacacggcttgttcggcttctatattttgcggaggaagccggtcattcagaaggtctgtcatgctaagcaccgtcctctcattaaaaaatctccaacctccattctaccatttctacagaaaaaaaatagaaaaattgtctgtttcctgtttttttcagttagcagattggatcgtttcggacagtaacaaggcgggaaaaatgcaataaaacatgagggaggaatgaaagatgataaagaaatatgcgattacgcctaatgttgatgcggacggctggtttattgaggtggagaatgtagcgccgacagctttgtatacgtctaaagacgccgctattgaaaaggccaaacaggtggctaaggaaaacagtccgtctaagcttgtaatttatgaccagtttaaaaatgtggaagaagaacactcattttaatgaatgaaagccttcgctgcagcgagggttttttagcggttatcggtttatttcatccattggatgcctatgtgcatcatcaaatctgccgctttttgatacagatcccactccccgatcgaagcaaatttccccatcagctcccgaagctttagcctcactgctatatattcttcgaaagtgacagctttttcagtgtctatttggtgttccttcagcatttgttttaataaagacaacggtgcgtgcataagaaccctccttacctcttttataacggtcattttccgattgctctattcctttgtgacatcttcttacatttcacatctgattcttgtacaatggacagaagagaggagggatcttttgtgagacctttgcaaatttctgctgaaactgcacaaaagcttgcagagtccttgaatctgccgcttgaacagatcatgcatatgcctcagcatattctgcttgccaaaatggctgaactgcaaaaagaggacaaatcatagccttcattcacatacttgcttacctgtttcgggataatatcatgtatatgttagaaaagaggagtaactgctttgccacatccacataataaaaaaatccaatcattttggctgatcaccggcattatctttatcgcctttaacttacggcctgcgatcacttcagtcggtccggtcatcagctctatccgggcagagctgcacatgtccaatggggcagccggttttttgaccgcactgccgctgctttcgtttgcagttctttctccgcttgcacctaagcttggacaacgcctcggaaatgagcgaactttatggctaggtctcgtgatactgcttatcggtgttttgactcgttctaccggctatactgccgctttgtttttcggaacggcacttatcggcgtcgggattgcgattggtaacgtacttttgccaagcttaatcaaacataaataccctgaaaagccagggatcatgatcagcctgtatacgacatcaatgaatatattcgcagctttagcatcgggtgtcagcgttcctttagcgacccagatgaatcgcggatggaaacaagcctttctcttatggggcgggctggctttgcttgcattgctgatctggatacctcagctgcgccatcgagatacggcaaaccagacaatgaagctgcaatccagttccatttgggcttccaaaatggcatggtatgtcaccatctttatgggcctgcaatcgtttttattttacagcagcatcgcttggtttcctgaaattctccgttcacacgggattgatacggcaacagccggatggatggtatcactcatgcaatttgcgagtctgccttccacttttctgacgccagttttagctgaccgtgtgaaacagcagcgcggtatcgttgcggcgctggcctcagtttatctgatcggcctctgcggattattagcgggcggaagccatacattgcttgccatctggatgatcattatcggtatcgggcaaggctccagcattagtctggcgctcactttgattggtctccgcagtgaaaatgcccaacaggccgctgcgctgtcaggcatgtctcagtcattcggctacctgctggcagcagtcgggccaatctttgtcggctatctctttgaccagacgcattcttggacgatgccgattgtgcttctcattgctgccctgatcgtaatgggagcagccggacagggagccggacgagatcgatacatttttcagtctgaaaaaaaaagaaattcagcataaaagcggggaaaatatctccgcttttttctttgaatatttatggtttattcataagtttttcatatttgttttttacaattagacaccataaagaggtgaaaaacgatgaaaaccaaacgattcgacgcagcccttatttttattttgctgggagcagcttttttgaatacgtatcacatttggcaggatgatgcagcgaaccagtactatttggcggctgtaaaaagcatgacgcaaagcttccataatttcttttatgcgtcatttgacccttctggatttgtgacagtagataagcctcctgtcgtgttatggattcaaacgattttcgcactgattttcggtgttcacacgtggagtgtcatcattccccaggctcttgccggagttggatctgtcttccttctctacagaatgattaagccgacttttggagttggagcggcccgcattgccgcacttgtcatggcactgacccctatcgcagtagctgtcagccggacaaacaatattgatagcatgctcgtttttaccatattgctcggttcagcttgcctgtttcgggcagtaaaacaaggcaagctggtttggctgctgatggcatttgccctgattgggctcgcctttaatatgaagatgatgcaagcgtttatggtattgcctgcatttgtgttattctacctggttgcatctcgggtttctctgaagaaaaaaatcgggcccctgcttctgtctcttgtccttctgacaggcctttcactctcatgggcgattgcagtggattcagcctcttcctcaagccggccttatgtaggaagcagccagaccaactcagtgctagaactggcctttggctacaacggcacagagcgtctgcttgggcaaactacgggcctagcaaagggtgatatgaatgctgctggcggagggaacatgcagaatcaagacaacatgcaagcgccaaatggcaacggttcatctttttctcagaacggaaatcaatcattcggaaaccattcacaggcgcctcagccgcctaacggacaaaccggcgctctcaatggaggcggaggcacacctcccacaggtggcaacgggcctggaaatggagggcctggcggcggaaaaagtatgaatatgttcggcaccggtgatcctggcccgcttcgtcttttccaatcagcactttccggccaaatcagctggatgcttccattctcattgatcggattactgggcgcaatcgtcagctggtaccgtgatcgccgcggacatgctgctaaaatgaaagaaacgctattctgggcggcttggcttgttcccgtggctggtttcttcagcatcgcaggattcttccaccagtattatttgattatgctggcaccgccgattgccgccctttctggtatcggatggtatacgatgcaccgcttatacaaaaataataaagactggtccagctatcttctgccggcagccgtcttgatcacagccgtgtttcagatgtatattctgagcgcttatacaagccaaatcggcagtgtatggatgtatgtcctggggctcttaggactgggcatcacccttgcacttctgatgcttaaacgcagccatccgttcagtaagctgctgaccatcatcagcttgtgcgttctgcttctcacaccagtttactggtcagcaacgccgcttctatacggtggtaacagcgtccttcctgaatctggcccgcagctcaaaggctcagcaaacggcgggaacatgttctcttcagaggtcgacagcgggctcctgtcctatctgagaaaacacaataccggcgaagaatacttatttgctactttgacaaccgtaacagctgcgccatacatcatttacgaaaatgaatctgttatggcaatgggcggatttaacggcacggatcccattctgactgtgtcggaactgaaaaaactgatcaaagaaggcaaagtgaaatacttccttctgtcagaaaacaactcaggcaacagcgaacttgtttcctggattaagaaaaacggaaaagaaataacatctgacgagtacagcggttcctccagcagcacgaacagcgtgcagggaatgcgaggaggacctggcggagaaagccagcaaactctttatctcgtggaataaaaaaaagaggcttggatgaatccaagcctcttttctattaagcttcttcttttacatgtacctttaacacagcctgcacttcaggatgcagcttcacaggcacgttcgtatatcctaatgcacgaatcccgtccggcagttcaagcttccgcttatctactttaatgttatggtctttttggagctgttcagtaatttgcttgcttgtcactgaaccaaataaacggccgccctcacctgattttgcgctaagctcaacagtcagtttttctaatgtctctttcaagctcttagcctgctcaagctcggcaatggcttcttttttctctttctgctgttgtccgtttagcgcgctgatgtttgaagcgttcgcttcaaccgcgaggccttttttaattagaaagttatgcgcataaccgtctgctacgtttttgacttcgcctttttttccttttccttttacatcttgtaagaaaataaccttcatctctgtacgcctccctcaaaatactcatctatggcgtgcttcagccgttccagcgcttcagaaactgaaatgccggacaactgagtcgccgcatttgttaaatgccctccgccttccagggcctccatgatgatctgaacatttacctcgccaagcgaccgcgcactgatacaaaccgtttgttcatcccgtctcgccaccgcaaatgaagcctcaacctcactcatcgacagcagtgaatcagcagcctgcgcaatcagcacttgatcgaagtattcctcttcattttcaggaagagaagcaatcgcaatgttatctttatagaggaccgtatgctggatcagcttcgcccgtttaatataggaatcaacggtttctttcaggaacttctgcaccagcaccgtgtcggcgccttttgcccttaaataagaagccgcatcaaaagtccgcgagcccgtgcggagagaaaagctctttgtatccactattataccagctaatagggctgttgcttcaatcatattgatttttaagcgcttcggctgatattcaagcagctctgtcaccaattccgctgtggaagaagcgtatggttccatataaacgagcagcggatctctgataaactcctcacctctgcggtgatggtcgatgaccacgatatgttcaattttattgaccagccgttcctccataacgagtgacggcttatgtgtatcaacgatcacaagcagtgtgtcatcattggaaatttccattgcttcttcaggcgtaataaatcttgaccacagttcttcatattttttgatttccccaatcaaacgctgcacacttgatccgatttgatttgggtcaatcacgataaaaccatctttgttatttgcctgagccacctttaaaatcccgatcgctgcgccgatagaatccatgtcggggaatttatgccccatgataatcacattgctgctttcggtgacgatttcctttaaggcgtgagaaatcacgcgggcccgcacccttgttcgtttctccattgggtttgttttaccgccgtaaaacttcaccttgccgtttggcagcttaatggctacctggtctccgccgcgtcccagtgctaagtccaagctggattgcgccaaatcgccaagttctttcagggaagagactgaagccccgacaccgacgcttaacgtcagcgctacaccgtcaaacgaggttttttcccgcacttcatcaagaatcgaaaacttcgaattttcgagttcagttaagatgtgttcattaagtacagcgataaagcgttctgaagacgtccttttcaagaagatcccgtactcctgcgcccaagcgttcagcaaagatgtcacctggctgttcatcgtgcttctcgtctggtcatccaatccttgtgtcacatcatcatagttatcaaggaaaatatatgccaggacggttctttcgttttcatatagcttttcaatctgaatttgttctgttacatcaaagaaatataacagacgctcatcccgtttgatgacaaccctaaacttgcggtcattcaatgtaaccgtttccgattccacctcttgtttgataagcggcactaccgattcacaagtatcgtaaagtgatctccccactaaagtgctttcattaaagcaagaggaaagaaacggatttgcccattctatataatattggtcattaaaaagcatgattccaatcggcatttccatcaatgcctcttcaccgacttttttcaacctgtaggacaacgtagaaatataagcatcaatctcttgtcgaataagagaatcagcacgcttaataaaaaacaaaataactgccagcagcagcacttcgacggttcctaatatccagttaaaataaaagctgatgaggattgtaataattgacagagcaatcaatgcatagatgggataccgaaacagcggtttttcataaaagcttggcatttctatcactccccaccatgtgagtaaaactcatgttcacttcaccttattccttatatgaaagcccatatctaaaacgcctaaaatgcgaatggctgccatgaagaccggatgcacaaacccaagtatgacagcaatcacagccgcagcctttggatattgtttcttatggcaatagaaaaagataaatgataaaccttggatgaaaatcagaaacccgagtataaactccccatttaaagcgatagagtacagcatttggcctttttctaaaggcaaaaatgaaagcatgacaataatcaaatacagtactacaacactttgcggaaacttcaactctctaaaaggctttagattaggaatatcgggggagaatcgccttaagagcggcttagcgataaggtaactgaggaaagaaaaaataactcctaccatcacaatagctgttggaaaaagatattgaacgatacccaattgttcttccatcagttttaattgcttctcaaactgtccagcattgcccgactgcttcgctacagtttctaccatatcaagagattgccggtattgtgtcatcgcctcatcaatgatattgatacccaaaaactgaatgcttatcacaaaatagaagacaatactaagcatataaataagagcgcccgaaataatggcgtgcccgggctctttccttttgaaaaaatgtcccatggcaatgccggcgcaagctgacataaaagctacaataagcccgttaaaggacccgacaataaaaacaaccggaagactgacagcgcccatccatatccctagcttcaatccatgtctgatcgtatacaagatcattggcagcggcagtgcaaataacagaattgttccaatcacaggaacataaacgaccagaagcgtgatgatcgcaaacagactgattaaaatagcaccttccattaaagctctcgtttgtttcacttagtcacctcgtatcatcctgaacatacgaatagaaaagagcagcataaacgactgctctttttcatcgctgcaacatacgttgcaccgaatgtttttatatcatctctaaattttacttttatattttaacataagtccaaatcgcaagtaaaatgacgctaatgtttcatgtgaaacataaaaaatgaaaagacattctttgaaaagaatgcccatcacaattaatgtttatcatccataaagccagaagattccttgtttttctttttcgtttttctgacatacataaaaattaagatcaccagtaaaagggttgttgcttgcagaacgccgctgctaaacaagaaaaagttctttatcatgtcccacattgtgtttcacctctttgtgcatgttctcaacccgtatcctatataaggtgaatttccctttttataaacttcaaaacatcatgaacaacattgagcgttgggcatatgctgatatggaatctgatcgataaaggagaattttcacatggatgaacgcagaacattggcttggcatgaaacattagaaatgcacgagctggttgcttttcaatcaaacggactcattaaactgaagaaaatgataagagaagtaaaagaccctcagctcagacagctttataacgtgtctattcagagcgttgagcaaaatttgagagagcttcttccgttctttccacaggctccgcacagagaagatgaggaagaagaacgcgcagataacccattttacagcggtgacctgctcggttttgccaaaacatctgtccgcagctatgccatcgcaattacagaaacagcaacacctcaattaagaaacgtactggtcaaacagctgaatgctgccatccagctgcacgcccaagtttatcgatacatgtatcagcatggatattatccgtcttacaacctttctgaactgttgaaaaacgatgtcagaaacgccaacagagccatttcaatgaaataaaacaagcagcaaaggagttccctttgctgctatttctgctgatccttcactaagccgttcgaacgataagattccagcacgtctctgttggattctccccattctttcatttgcaaaacaatcggttcaagcgttcgcccgaattctgtcagagagtactcaaccttgggcggcacctgttgataaacctcacgatgcacgatgccgtccgcttccagctccctcagctgaagagtaagcattctttgagtaatactcgggcagattcgccgaaactcattaaatcgtttcttgccatctatcatgtgataaaaaagaattcctttccactttccgccaatgacatctagagtaaattcaactggacagccttctttgttcgggtatatattcttttttccactcattcttgaccctccaatagtaccttttttgatactacattacattttgcaactaagctacccagtattttacacaccttttctccttagctcaaagaaaatgcttcttattcacatcaatttttaagggtttgcatgattacacctgcagcaagacgtgttaaactatataaagattacactacttaaaaaaaggataggagctatcatggaaaagatacttattttcggacaccaaaacccagacacagatacgatttgttctgcgattgcttatgctgatttgaaaaacaaactcggcttcaatgctgagcctgtccgtctcggacaagtcaacggcgaaacacaatacgcgcttgactatttcaaacaagaaagcccgcgtcttgttgaaacagctgcaaacgaagtaaacggcgttatcctggttgaccataacgaacgccagcaaagcatcaaagacattgaagaggttcaggttttagaggttatcgaccatcaccgcatcgctaactttgaaacagctgagccgctttactatcgtgctgagcctgtaggctgtacggctaccatcttaaacaaaatgtacaaagagaataacgtgaaaatcgagaaagaaattgccggccttatgctgtctgcgatcatttctgattccctgttatttaaatctccaacttgcacagaccaagacgtagcggcagcaaaagagcttgcggagatcgctggcgtagatgctgaagaatacggcttgaacatgctgaaagcaggcgctgatctaagcaaaaaaacagtggaagagctcatttctcttgatgcgaaagaatttacactcggcagcaagaaagtcgaaatcgcacaagtaaacacagtggacattgaagatgtgaaaaaacgccaagctgaattagaagctgtgatctcaaaagttgtggctgagaagaatcttgatctgttccttctcgttatcacagatatcttagaaaatgattcacttgctcttgcaatcggtaacgaagcagcgaaagtggaaaaagcgttcaacgttactttagaaaacaacacagccctcttaaaaggtgttgtttcccgtaaaaaacaagtcgttcctgtcttaacagacgcaatggctgaataagcaaaaagcatcccgcatcgggatgctttttcttattcacccagcttctcaatttgtcccatcacatcagtaatttgctttgcgttttggaccaggtctgactgctccaattctttaagcgataccttgccttcctcggcttgtttcaacacctcttcagcgcttttctgcaaggtttcgttatgctcctgaatggttcgatgaatctccgctgcggcatcaggcggcgttaattcattaaaatcagcggcatccttctgaatcgattcaagctgcgcttcaagtttttctttcgcctcggtgtcatttacagctttctcagccaattcaggcgcttcctctgcaaatgtcttcaccttctccacataccccgctgcttcactcgtatagttcaatccgtcgttcacctgatcaagcatgccgcatccgcctgcactcaaaagtcccactccggcaagtactgtcaaaatgatcttcatcttcagccccctcatcgtttctttttcattttttcttttaagatcggaatcaatttctctttcgctaacggcagccctttcctcaccaattcacgcttcagccactttttcagcttagacattctgatgctcctctccctttttgataaaaatgaaaaaactccaccaatttggtgaagttcctgaaacaaaaagaccttcaccaaatcagatttggcaaaggtctcgctaacaaatgagattgccagcaaagccgaggacaacttgtcccgtaatgacgactttactgtgaaagctactcccctttggagtgttcatttttattactttcattctaaagcaccgatctgttccagtcaaattcctgccgtttatataaaagcgcgctgtggtatttaaaatttgaatggtttttccatcaggagatcatgctatgacagaggaggttttcatcatgagtcaagagcgcgtgaaacggcctgggcataccagatggtacatatcttcgttacttagcggcattattattcttaattattttgaccgagtggccatctcggtagcggcccctgcgatacaagattcgtttcaccttactgcaactgaactcggcatcgtgttttccatttacacctattcctatacactgatgcagctgcctgtcggaagtttgctggaccgttttggggtcgcatgggtcacgagggttggaatgacaatatggagctttttaacgatccttcttgcttttttgcaaggaaaattgctgttgtatctgttccggtttctcattgggctgacgagcgcctctgcgttccctgctgcctctaaagcaaccgctctctggtttcctccaagtgagcggggattggcaaactcactgttcgattcggccgccaagttttcaaatgtaatcggcgcgccattggtcgcctttcttgtcacaacatttgactggcgtgtcgcttttttgacgattggatgcatcaatgtgctgtttacgatctttttctggcagtattatgaacagcctgaacggcacaaacgtatttctaaaagtgaactaaactatattcaaaaacacaatgccattacaacagagcaaatcccttacaaaacgggcccgcttttaaaaaagcttttcaccaatcggaaagtatggggcttaatgatcggatttacagggtacgggtatacattcaacctgctgctcacctggcttccgactttctttaaacatacatacggtatggatctcatgtcgtccggtttatttacggcagtgccgtggctgatctcaaccatttccggaattgccgtcggcggctggctcgtcgattattttattaagaaaggctatcctaacaccaaggtgtaccgaaccgtaatcatagtcggaatgagctttggctttttctttttaggctccattctgacgaacaatattaccgtagccattatttgcatttccatcggactcgccggaatttcagcaaccgctccggtcggctggtccatctccgcagaactcgcgccgatcggttccgtatccatgctgagctccatggtgaatctcgcaaacaacctgttcggaggcattattgctgcgtcactgacagggtatttgtttgatgtgacaggctcctttacactcagctttctggtagctggttttgtgctgttgctgggattggttttttatgtgtttgtattaggggatgtaaaacgaattaaactggaatgaagagtgcttgctgaaaagcactcttttctttgaatccgccaggtgttattttctttctcccaacattcactaggctgtcttcggacgaaaacaccaccattttatccttgactccaaccaaaggtaaggcctcatagtgaaagaagaaaggaggagtcagatggtgaaattaacagtaaaagaactatccaatattgcgaatgtcacaatcaaaacgctttatcattaccacaaaatcggcttgctagccccaaaggaaataagcgaagccggatatcggtactatggtgctgaagaactaaaaagactgcaggaaatccttttttacaaagaattagatattcctttgtcagaaatcaaaacattactaaaagaggatgctgaaagaacaagtacattagaaaaacaaaaaaagctgtttgaaaagaaaattgaaaagtatcagcgtctcattcaaacagtcaacacatctttagaatacacgagaaaaggcgaaaacatggatcataaggtaatgtttaaaggatttgaaagcgctgaagaatggaaacaatctttagcagaacaaaatgggtatttaaaagagcgttacgattttgaattggatacacatacaatcaatgtcgatgaaatgaacaaaatggcaatagaggctaaacattttcttgataggatggctgattttttaagaaacggtgtaacgtatcatgacccttccgtgcaagagcatgtcatgaatcatcttaagttcctaaatcagaacgggcatccgacaagtaaagaagattacgtaaaacaaacacgtttttttatgcaagatgatttccatagaggaatgttagaagagcagcaaaccggtttatcttattatttggttgtcgttgcagaacacctgtagtgttttgtcaccctttatagggtgacagccatcaggattacgagacagcaccgccaacaatcgaaacattctgccggtcaacggcaaaacgccgtccgttccattttaatacggtttgaacatatcccaatgagtcggcgttataccttcccgctatccgctggtacgccaataattcgtatacgccgtctctgtcaaaatcaaccggatacaaacccgataaaggattcacccatccttctatcggcatttttaacacaccttggctgttataaatctcattcaaatattccctgcctttgtaagtaaggtcgaggatatacgtttcgttttgctgatgactgatgacgctcgctttatattgattttgatacctcacactgtactttaattcatcattcaatacatctgaattgaaaattcgccggaactgcctgtttagataggcaaacacgtatgcataaatagcaccgccgcttccccctgtatctattaccaccgccacatcctcaatcttgtcgcctgtcatatcccccagaaaaagtgacggattgtatcccatattgttttgaagctgaatctgctgctcctgatgggttctgccatcacagatcaccaatgtgatatttctccataacaggctgccgggcatttgatttccagttagaaagacctcatcaataacgccgtctcccgttacatcgccgcgagtagatgcaatgattgcacgtgaggagacaggctgccgaaatacgtatggatgttgaacaagtcctctgctttcataaaaccaataaggagccattctgatgtcatacacattcaattgtgtcaccttccctaatcagctgaatgaatcattatatgcaggaatggcacatcaaagacatatcttacacaccaattaaatccgtaccataagagttatcgattacacaaagccactcgccttgcgcattcttcttaaatacataggtcgcccttctttccatcgcatactcggagtcctttttatccgaatcaagcagtgtctgagaaaggacgagtaccgtgtcacctgcttctaacaggatcatttccccttgtttcgggacaatatgatgattgaaatagttcacaatcgtaataaacgcttttttgatttcttctttgcctcgcgcgatcatgcccggcttcacgactaaaacggcatcttccgaataataattcatcagtgtatcaaaatcttcattttggattgccaaatcacacgcagagatgatgtctttcaattgctgttccaaatgaattcccccaatcatcatgattggatatattatacatcgctagaccactgaaaccttgaaaacaaaatgaaaagtatccttttttcctatataatcaaatagatatatttaacaaagtacccaagtgaaggggtgaacattattgtctgcggaagtaacgttacatgacaatatacattatgatttaagtgcggattgccagcactgttttggcctgtgctgtgtcgccttgccttatgcgaagtcggcagattttgcttttgataaagacgggggcacgccttgccgcaacttacaatcaaactatcaatgttctatacataaagatctcagagaaaaaggatttcgaggctgctctgcatatgaatgctttggcgccggccaaaaagtatcccaaatcacttatgagggaaaggattggcgaaacagccccgaaacggccaaccagatgtttgacgtttttcctatcatgcagcagctgcacgaaatgctctggtatttacatgaagctctttctatagatatagccaagccgattcatcctgaactgagaaccagtttcgaaaaaatagaaaggctcaccaggctcagcaaagaacgcttgctgacactgcaggtggacgagcatcgagctgaggtcaatgaatggctgttaaaaacgagtgaactggtgcgtgcccaagcccgccatccaaaactcccgaaaaaggtcagccggggaagtgtcctgatcggcgcgaaactgaaagggcttgatctgcgaggagcaaatctaagaggggcgctgctcatagccgccgatctgagatttgccgatttgagaatgacagactttatcggtgcagatatgagagacgctgatctcagcggcgccgacctgaccgggagcatctttctgacacaggcacaggtgaacgccgccaacggcgattcgaaaacaaagctgccgctgtctgtacgaacccctgcccattggaaataaaaaaggacccgctaacggtccttttttactgatcaattcaatcctttttcgttccttttatccggcattttcacacttcttgccaagtatcccgacagccataacgcaaccagcagcatgaaggtgatcataccgacgacgcccagccagtgaaaagcagaccagaatagccctccgactgttccgcaaacacttgaaccggcgtaataaaagaacaaatacagcgatgaagcctgtgctttgttatgaagggctctcctgcccacccaactgctggcaactgaatgtccgccgaaaaaaccgaatgtaaagagggcaatccccagaattttcactgccagcatactgtttatcgtgaataaagcacctgcaatgacgatgaaaatattcatcaccagtatttttggatagccatatcgatcaaccattcttccaatgaaagacgagctgaaaatgcctacaatcatcacaataaatatccagctggcaaatgctttattaagcgaatacggcgggcccaacagcacatacacaatgtaattaaacaaggcaacattgcttccgagcagcaaaaaaccaatgagaaacaaactgaatagttttcggtccttcaagtggccaatcagagacattcccaatttcccgagcttcaattttcttggcgtaaaatgcctggatggcggcaaatttataaaaaatataacactagcaatcaaactaatgacaccaattgatcccatcgccatatgccaattcaagtactcgctcaggagcccggaaacgatccttccgaaaacggcgccgattgcatttccgctgatatacagccccatcgccgacccaagacttccgggttcaatttcttccccgagataagccatcgcaatcgacggaaggcctgcgagcgcaacgccttgaatggttctcaatacgagcagcgtatgaaagtttggactaaaggccgatgccagacagagaaccgatgcggccagcatggaaatacccataatcggcttgcgcccccacacctcggataatgaaccaaagacaagcatgctcacagctaacagcattgtggtaacagataaagaaagactcgccgcagtaggcgttacatgaaattcccgcgtgaattcctccatgagcggctgtacgcaatatagaatcgcaaatgtattgaaacccgcagcgaagaaagcaaacgtaatttttcgaaaaaccggtgtgcctttttgaatgtatgtcatcgggactttatcggtccctcatcatgttgtggagcactgccattcataaacaaccatcctttatttcttccgaattcaaacatcctcgagtctgtttatattactatcttagcaccgttgatatatgttgtataatgcatataaaatatcattttcatgcttatatgtaataaaggagggatgataattggaatgggaacaacttgaatattttcaaacactggcccggatgcagcacgtcacgaaagccgcaaaaagcctctccatcacacagcctgcgctttcacgctctatcgccaggctggaaaatcatttgggcgtcccgctatttgacaggcaaggacgatccatcagcttaaatcaatacggacacatttttttgcggcgggttcaggcgatgatgaaggagtacaccgaaggaaaagaagaaatccaagccttattaaagccagaccaaggcgtagtctctctcggttttttacatacattaggcaccacgctcgtgcccgatctcatcggctcctttcagcaggaataccccaacattgccttccagctgaagcaaaaccactcttattggctgcttgaacgattaaaatccggagatctggacctctgtctcctcgcttcgattaagcctgaaaatccgatccaatggatcaagctgtggagtgaagaactctttgtatttgtgccaaatgatcatccattagccagtcgcgaaagcattaccctgaatgagattgccggggagcgttttattttattgaaaaagggctatgcgcttcggatgacggtcgatgagctgtttgagaaggccgatatacagccgaacattatgtttgaaggagaagaagcagctactgccgcaggttttgtggcagccggactgggcatatctattctcccagacctgaaaggcttagaccaaagcaaaatcaccaaaatccgcgtcagctggccggaatgtcagcgtgtcataggaattgcctggataaaaggcaggtttttatcaccggttgctgagacctttaaacaatatgtgatcagccatttttctgagtagggaggattcaaacatgaatgtcaaaaaaatcacgtcagaacaggatttacatacagcgtttgaaatcagaaaggcagtatttgtagaggaacaaggctgtcccatttcggatgaattcgatgagttcgatacactccacggtgactgccagcacatcctagcttatcatcagaatgtacctgttggcactgcacgtgtccgtatcgttggccacgcggggaaactggaacgaatctgcattctgaagtcttaccgcaaattcggtttgggaaaagtgatcgtcgatgcattagaacgtattgtgaaagaacaaggcatttctgccttcaaactgcacggccagacacaggcggcaggcttttatgaaaagctcggctatcagactgcatcagaagaatttatgctggacggcattccgcatgtactgatgacaaaacaagacgattctgctttatagattgttcacaaatttgtcacttatgagcatgaacagttcattggtatactaatcaccgattatggagagaaggaatgattgtatgccagcaaataaaaaagagggtcttatatttggcgtgatgatgtgttttggaatggtctgcgtcatgtcgatttacaatgccatcatcaacggagccattcaggatttttcactggtgaccgtttttgaaatggccatcggttttatggtcgccctcctgttcgatttactgttagtgggccccctcgccaagaagattgcattccgcatgccgttcgacaagactaaaaaaatttatgtcatccttgccatgtcaacttgtatggtgattggcatggtactttgtatgtctgtgttcggtttagtgacagcggttctggcaaatgggctgaacggggacagcctcttcagtgcttaccttatgatggtgttgaaaaatttcatcctggcctatccattgcaattactgattatgggcccattagtcagagggattttcatgaaatttgtaaaaccaaagctcaaaactgcaatttaaatagaaaaggagtgagcctgacactcactccttttgctcatgaatcgaatgtaaaacaagctccgcaaaagcctctgcggcaggcagctgccattttttctttttgagtaaatcggatcaaggactgcaccatgctgaagaactttcagcttatgtttttcacttccattaatccctataccttaccaaatagtttttatacaattcttcgttataaagaatttcttcgccatgtgaagagcaaatgagcgttggtttgatttgatctatgattgagccgctatcgatgttctcatttatatcaacactgaatcttcttataggtgggtgtaaatcctccttacttgtgataaaaaggtcgcccgttaatagcgtacgatcgattttatgatcatacacgacatgccccggcgaatggccaggtgttaaatagtatttcagaggcaggtgagcaagcgtttgctccgtcagcggctggacaatatgggctacccctgtgttctccacttcatttttgttcggatatggctcttccccattgatgtattttagttctttctggtgcgcaaaaatcggaatatcaaatctcactaaccattttgatgcacctccgatatgatcactgtggccatgggtaagcaaaatggcttttggattgccgatcgctaacgctgccctaatttgagcatcagcaaaacgttctattcccgtatcaacaatatatacatcatcaccatctttgataaaccaggtatgaaccggaatccgaagaggcacatcaagctcaaattcacattgatagacatgctctgataattgtctcaagttcacgcaaaccactccctttggagatttttgatagtttaaaagaaaaatagaagtgaacggactattttcaaggcagattatcttgaaaatggtcccacactccagcggaccggtattcttgaggaggagacgccgattttcgccagcatcagctcgacttgttaacattgtccattaataatccctcttgttccccttcttcacatactcccaatcacgttctatattcttcctcactctatgaaggagtgcagaaatggtttccttttcctctgaagtaaaaccggacaaggccacttccgtggaatgttctccttctcttcttaacaatggatatacctttttccctttctcagtcgggaacagtttttttatttttttattttgctcatctggcagtttttgaataaatccctgcatttccagcttcttaatggcccgcgcggccgttgtccggtccacctttatcatttccgccaatttttcttgaataattcctggattctcgtatatacgtacgagatagaggtactgccctcttgttaagtccaaatctttaaattcgatgttgcttatggaatccaacgctcttgctatcatgccgatctcacgcaaaatatcattcattcctaaaacccctcacgtatttttgttgcaattacaacaaaaatgttttaaccttactattataagaccacatgcgtgctgtacagtccagactaatatcagaaaaggattgattcataatgaatataaaaagaataacaactgaagctgatttacatgaagctttgaatattagaaagacggttttcattgaggagcaacatgtatcggaatccgaagagttcgatgaatttgatacgctccaggaacaatgccagcatgtcttggtatatcatgagaatcagcctgtcggcacgggccgtgtgcgcatcgttgaccatacagcaaagctggaaagaatctgcatcctaaaaccttaccgtaagtatggattgggaaaagtcatcgtaagcgggttagaagaaatcataaaagaaaaaggactgactgcatgtaagctgcatggtcaaacacaagcagcaggcttttatcaaaaactgggctaccagatttcttcacaggaatttatggaagacggcatccctcacgtcctgatgacaaaagacatatcgcggatttaacatgaaatatattttttacggattaggaatacttatattaagtttgggcatttccttaaccatacaatcaggactgggcacatcacccttcgatgcccttttggtgggtctgtcaaaagaaatcggtcttaccgtaggaagctgggaggtccttatttctgtgatcctcttaatctgcaacgctatattaacgagaaaaaaacctattttgctgggcttgattacagcattcattactggaataggcattgacctatggttgtttgttgtaaaaaacaccctctatctaaacgcgttgttaagcaaactgatttgtttcggaattggtttggtgctcatcggtcttggaacagccatctatcttcagacgaaattcgcatcaacgcccatcgatcatttaacacttattatccgagatctctccaaaagaacaatcttgttttcaagaacattggtatacgctcttttcttagtattagccatcatctttaaaggccctatcggcatcggaaccctattaaccgtctgtttgggaggaatgatccttcacgtttttatgcctattgtggaaaaacaattcttatcaaaaaaaagaaggggttaaaaaacctcttctttgaaaaaacgaaacgcaaaacaagctacgtttcgttcaataattttatgataaattaaaatttatagtaccaaaaaatcgcaatttcatttgctgttggaaggttggaataaagcatcgtatcaactgcacctattataaagtgatgtttggcataaaaacgacaagctgaaacattaatatcttgtgtttcaagcataagaccaaaaaagcgattctcctttgcccactcaatcgctttatgtaataatgctgttccaacgcctttttgtctatagtcttttgcaacggcaatgtcctctattagtgcatacccattccagttagaacgaatcttaatccggccgatgcagttgttttcaacataatataaaaaaaccgcttttccctcttcttcaacataactaacatccatttcatcatcttcatattgtttaaaataaggtttagaaaatcgttcctcagtatatgtccaaacaccgttttcaaaagcaggtatcattctcccaaaaacaacgaaaggttcatttggtttattgaaatctttcaaattcatttgagtcattttcttgatcatatcaatcccctcctaaacgagattatattagcatactcgtttcgatcgataacagcttccaaaagggcactctttaaaagaacagcatccattaccttttatataagcgatttttctatttcactgtcttaatggggtatttcaacagaggcttgtggtacagtaaaaaggaatagaaacaagagaaaagaagatgaacctatgcccactaacaataaactcaatgagaaatatcatacttccttcaactcgcccacaaccctgttgactagtatccgtggagagaggaagctttgacacagcttctgccattgatgacatctctattgaagtatccaaaggacaaccaaggatcgctatttgactttttcaagaagaaagtagagtgaataaaggagtgattgagtatgttaacaagagaagatatctttaaacacgtcaaagaaaaatacggtacatcgcctgattacccgtgggagaaatacccaaactatgcttctttgagacatacatcaaacaaaaaatggtacggtcttatcatgaatgttctcccagaaaaattaggcttggatggtcatggcgaaatagatattctaaatctaaaatgtccccctgacataagtgatagcttaagaaacggggaaaatatcttacccggatatcatatggataaggaacattggatttcaattgttttagaacggacagatccagaaggcgaaatctataacttaatcgagcagagctttcatttaaccaagtgaagataaagagtgttccggctaatcaagctgcgaagagtagtgggcactttcattttaggatactgttcttcactcagtccataaacgcaacttagtctatctggtgcgagagtgggagaagaatttctaccaacttcttatggaaaaggatgaatagttatgacaaataacttaaaacagagaagaatcattttagatttagcagttactttagatggttttattgaagggaaaaatggagaagttgattggtgcattatggaccctgatatggggtttactgatttcttaaatcaaattgatactattttatatggcagaaaaagctacgatttatggggacaatatattccaaaagatgaagaccctgatacagaaaaggaaatttgggaattggttcatagtaaaaagaaatatgttttttccagaacacaaaatgagattgataatcaagccatatttataaatgataatattcttgaagaaggaaataaattgaagaaaaagtctggcaaagacatctggctatatggtggagcgagtctcattacaacttttataaatttggggcttgttgatgaatttagattatctattcaccctgttgttttgggagaaggaaaaccgttgtttattgatgtaaaacagaggataaatttaaaaatggtgaatacaagaacattttcctctggcgttgtgcaaatcgtttatcattggaatggctaacattgtaaagtaacactcgacagtaatccttcttattgaactaaaggggaatccataaataatgggttccccttaatatactatggaactatcaatatcaaattttctgtaataaaagaggattgaaaaggacggtgtctcctccattaacatcattaagcattatagtatattttcttctccctcttttaagtaaatcggctaagttttgtgtttataaaaaaacgaaagaaggtgatcctatgcccaataacaataaatccaatagattaatcgctgagaagtctacttattttacttcaacatgctcataaccctgtggactggttcccttggggagaagaagcatatgaaaaagcgaaacgcgaaaacaagcctgttctcgtatctattgggtatagctaacgatggctaatctaaagaacatgctattgatgccatgtttattcattttacaaaaaaggatcaaccttgaattactttcacaagattgatcctttcactcatttagccatgtctccgcgaacgtttatatacattcaagattactagccaacaaataacaatgattcctgcaaaaagtatgagcatattgctatacaaataggtagagtgatcaacgtcaataggcagcagcctatgatctaggaagccgatagataataaaccgcctacaatcgcaatacccgttccctctgataaaaagctcgtgaaattaagcaaactcattccagcgcccgcttccttttctttcaaactgctagacacaactgtagatataactgtttttgtgaaagatagccccccaaaaacaaaaattactataattgtcatgatccatggtgctgcatctataaaaaaggcagcgattaaaaagccggaagaaagcaatgcacttccaatagttagtacatacaaggaacctttccgatcaacaagcaatcccccaatgtaaccaaagatgatgacactcattgttccggggaaaataatgccgcttccaattgctgcagtacttaaatggtgaacatctttcatcatgtaaggaaccatagagacaaatcctgctactgtaccaaatattagtcctccgcaaagggttccaatcacaaaaaagacgtttttccctaattcagggtcaacaaaagggtcctgagctttcctaatgtgttgcacaaatatgaagaaagcaaggatactgatgatcagaaaagaaaatctataagatgttgtaaacagcataaaaaatacgatacctgcagacatcaatataatccctgccatatcaatgtgtcctcttattctctcttcctttttcaacaattttataaggaatggaacggtgataattgttgcagttggaataagcagcaaatacgaccaatggatataatgagcaaccattccgccaatagctggcccaacaccttctcccattgctaccagggacccgatcaggccaaatgctttccccctgttctcttttggaatatagcgcgcaacgacaaccatcacaagagctgggaatgcggctgcaccaattccttgaataaatcgggctagaatgagaataggaaagaaagagtgtccaacaaatccaatgatcgaccctaagccatttaccataatcccaaatagaagcagatttttgatgcccagctggtctgatagctttccatatagagctgttccaatggagaaggttaacataaaggctgtattcacccagtttgcacttgctggcagtttattaaactcgttggcaatatcaggtaatgagacgttcagaaccatttcatttaatacgctgaaaaatgatagaacacaaagccaaatcaaaacttgattgtgccgtaaagttgactgtgaataagacgtattcacaatttcccctccattaatgagggcagacgcagtttatagggtcattgatacgcttccctcttttaattgtaccctgttcattttattgcacttcataataactccccctacatttgattgatatgatcttattatatatagactaaggattaaacttttactttttttataaaaatttgaccagattgcgaaacaaggaaaaacgttattcgcatttatctcaagtggcaaaatgaaacattagtttatattttcacatcacaattatcgataagcagtcagttattgtatttgtttaggataactgtggtaacctgaatataaccaacttaggaagaaggtgatcccatgccaaataaaagtaaacccaatagattaatcgctgaaaagtctccttatttactccaacacgcccacaaccctgtggactggttcccgtggggagaagaagcatttgcaaaagcaaaacgcgaaaacaagccggttctggtcagcatcggttattcgacgacttgtcattggtggcctaggataatcaaatcgtgtggaactccattaaaagataacagaagccattttaaacgataatactatttgttcaaacaatacagtctaccttttatttcattcattttctaaaacctgtaatccgtaaccacgcggtagcaggtttttttatttgcttgacttagagttaactctaaattgtaaactaactttaattaaatgagagggatgatgttgttgtattccattagtaaagctgctgagaagactagtattagttcgtatacattaagatattacgaaaagattgggttacttccaccaccaaaacgaaaaaacagtggaaggcgtttttatacggagactgatattcagttcatgttattcctgaaaagtttaaaggaaacaggtatgtctttggaggatattaatgagtttgtcaaagacggatgcattttggaaaaaatcaattcggatgttaaatcggcacaactctccccatctataaataaacgtattgagattttaaccaagcacttagagaaaatggaaattaaaaaaagggagctggaagaagtgatttctactacaaaaggaaaactggatacatatttttcaattttgaaagaggaagtggaaaacaaatgaaacatttaaatatatacataatgttacttggcttctctattttcacgggagctacttttaatcttgcaaaatatacagttggatatttttctccatcgtcttctgcggcatggcgtttcggtttagcggctgcagtgatgctcatcattttgatttttactgaaggtataaagaagagtcaattacggaaaaacgccgtttcatacattattcttggaattataggaatctttggatttaatgccttgttttttgttggtttaaaatatacatctcccgttaacggagcattaataatggggctgaatcctttattaacagcaattctcgctcgaattatcttaaaggacaacatgacaaaaaaacaagtactcggcatattctttgcattcatcggtgtattgttagtcattacacaaggttctatcgaaaccattaaaaccttatcaatttcaggaggagacttaataatctttacaggtaacgtttgttgggcactttatggcgtacttggacgtcggtttgtaaaggatggtacaccgctatctacaaccacttatacgatggttattggtgctgttagtttaatagtagtttccttatttacatccaaacctgtttctttatcgaacatcccgattggagtttggggggcaattgcttttatggctttctttacaagtgttttgggttacctatggtggaatcaggggattaaagagattggggctagtaaaacatctttatttttcaaccttgttcccgttgtaacgatgattatttcatttgccgttggaacaccaataaaggtatttcaagttattggggctgtgctagttatattaggcgttttaaccgcttcgggggtaatacgtattcctaagtacaatactaaagaacagtcagctatataaagaaatagggagtatttttgagaaaatgtgttaagttaaatatacactaattataggaagaaggtgatcccatgccaaacaaaagtaaacccaatagattaatcaatgagaaatcaccatatttactccaacacgcccacaaccctgtggactggttcccgtggggagaagaagcttttgaaaaagcaaaacgcgaaaacaagccggttctggtcagcatcggttattcgacttgtcattggtgccacgttatggctcacgaaagctttgaagacgaagaaatcgcgcgtcttctcaatgaacggtttgtggcgattaaagtcgaccgggaagagcggccggatgtggattctgtttatatgagaatctgccagctgatgaccgggcagggcggctggccgctgaatgtgtttatcacgcctgatcagaagccgttttacgcgggtacatattttccaaagacgagcaaattcaatcgtcccggttttgttgatgtgcttgagcatctgtctgagacgtttgcgaacgaccgtgagcatgtcgaggatattgcggagaacgccgctaaacatttgcagaccaaaacagccgccaaatcaggcgaaggccttagcgagtcagcgatttcccggacattccagcagcttgccagcgggtttgatacgatctacggcggtttcgggcaggcaccgaaatttccgatgccccatatgctgatgtatttgcttcgttatcatcacaatacggggcaggataacgctttatacaacgtgacgaaaacgctggacagcatggcgaatggcggcatttacgatcatatcggctatgggttcgcccgctattcgaccgatgacgagtggctcgttccccactttgaaaaaatgctgtacgacaatgcgctgctgctgactgcttatacagaagcctatcaggtcacgcaaaacagccgctataaagagatttgtgaacagatcattacgttcattcagagggaaatgactcatgaagacggaagctttttctctgctttagacgcggatacagaaggagaagaaggaaagtactacgtgtggtcaaaggaagaaattctgaaaacgctcggggacgatctcggaacgctgtattgccaagtgtatgacatcactgaagaaggaaactttgaaggcaaaaatattcctaacctcattcacacaaagtgggaacaaatcaaagccgatgccgggttaaccgaaaaagagctcagtctcaaactcgaagacgcaagacagcagctcttgaagacacgcgaggaaagaacctatccgcatgtcgatgataaagtgctcacctcatggaacgcgctgatgatcgcgggtcttgcgaaagcggcaaaggtataccaggagccgaaatatctcagcctagcgaaagacgccatcacatttattgaaaacaaattaatcatcgacggccgtgtgatggtccgatatcgtgatggcgaagtgaaaaacaaaggctttatcgacgattacgcttttctcctatgggcttatctggatctctatgaagcttcgtttgatctatcttttttacaaaaagcgaagaaactgacagacgatatgatcagcttattttgggatgaggagcatggcggattctacttcaccggacacgatgctgaggccttaatcgtccgggaaaaagaagtgtacgacggcgccgtgccttcaggaaacagtgtggcagctgttcagctgctgcgtcttggacaagtcacaggcgacttatcactgatcgaaaaagcggaaacaatgttttccgtgttcaagccagacatcgacgcgtatccgagcggccatgctttctttatgcaaagtgtgttaaggcatctgatgcctaaaaaagaaatcgtgatttttggaagtgcagacgatccagccagaaaacaaatcataacggagcttcaaaaagcctttaagcctaacgactccattctggtggcagagcagcccgagcaatgcaaagacattgcgccatttgcagcagactaccgcatcatagacggcaaaacaaccgtgtatatttgtgaaaacttcgcctgccagcagccgacaacgaatatcgaagaagccatccaaacgttaataagcagcagggattaagacccttgctgcttactttttgatttcttatggtaccataaagcgatccccgcaaacacaagattgaccgctatcgtaaagaaagcctcccacatcgggttcccccgcgtaaccgtaaagagagaaggaattcctccatacacactgtttttttctgtaataaacatacacaaaaacatattattcgcggcatgggcgccaagtgatatttcgatgcttccagttttaatcgtgtaataggtccacacaaaaccaaatgttaaatactcaattcctgcccagacagcgccattgttcatttctggattcgcaaaatgcaatacgccaaacaatcctccgacaatcagtgtcaaaaatagaggatttttcgtcaatctcccgaaagcttgaagcaaaaatcccctgaaaaacagttcctcagctgatgtctgaatcggaaccaaaatgagggcagccgctagcagccagataaagcgtgaggcattaaactcttgcattgaatagctatcaggatgaatcgcaaaatcaatcaattgtacggcgatcatcagcaagaaataagcaataaagccaaaggaaattctccgccaattcatctttgaatttggtgtaatcacagttcggaaaggccgcttcaaaataaagcgcacagccagccaaactcccggaatggcgaataaataaatcacatgggacaaataaagatctacgaggggatcactcagcacagcttcatccaaatcaaacgtgatattgggattcacaataaccgtgaacagtatagcgaaaaggtaagctatattcccgaatacatataaccctaccatcaccaaaaaagcgaaaaaatatctccacaacgtattgtttccttctataggacggataaatgaattcattccttctatgtctcttcctttcaatgagaatattactatatatttgcataaattggtctatgaatctactgttttggaaatcttttaagcaaaattaaaatataaagtgtgaatttagttcttccatctagtgatttgaactctgttgccaatgaaccaagatacttataatagtcctaagaggggaattttcagtcttttcttactactcaaaagggggttttttatgaatacgatcttcaaacaaaagaatacacatcctttctcaaacgcagcgaatcgtttagaccgccttccgatttcacgcgttcatttccaagtgttaaccgctctcggcattgtttatttctttgatctcgcagatttatttaccctcagcaatgtagcgccggcactgatcgagcattggggcatcccgctttcaactattgctaacgtaacggctgcttcgtttttaggcatgtttttaggcgcttcactgggcggacggctgtccgatcgaatcggccgcaaaaaagccttaaatctatttgtctttgttttttcaatcgcatcgctatgcaatgctgcggcatgggacattccatctttaatgacattccgttttctcaccggatttggcgttgcagccgccatggtcattacgaatagctatttggcggaatttttcccttcaagtgtacgtggaaaatatatttctttttgtgccatgattggattgatcggggttccgatcaccaacattgtgtctgcctttgtcattcctcttggttcatggggatggaggctagtatttgtatggggtgccgtcggccttatttattttttctttattcgacggctggaagagtcgcctcgctggcacgaaaatcgcggggaatatgcgaaagccgatgcgatcctcaaccgaattgaggcacaggttgaaaaggagaaaggcccgcttccggcagcatcccagcctaaagtaagcgaaactgttaagcagcatgcaggttacgccggcttattgaaaggcagaaacctcaaaatcaccatcgtattatctgctgtatggatttttgaaacgtttgggttttacggatttgcctcatgggttccaagcctgttaaaaagcaatggtgtcaccatggaaaatacattgtggtataacgtattgcattccgtcggcgctccgcttggcgcactgctcggctccatgatttctgaaagatttcaaagaaaatggattttagctgcgagtgcgtttctgacggccatcgccgggctcttatatggtatgacttttattcccatcatgatcattgtctttggttttatcgtgaatatcacagaacgggtctttacctcgaacttatacgcctatacatctgaaccttatccgactgaataccgctcgtctggcagcggtttagcctatggtcttggccgtttttcaaacatttttggctcattgcttgtcggatttattgccgttcagctcggctatatcagcgtcttcttatttattgggggctgctggctcgcatgctccttgctgttaatcttcttcggtcctaatacgaatgcgaaacagatttaaaaaagtcagtgcggatctgccgcactgatctcattacaattgcttcaaaatcctcgcggggtttccgcctacaacagtattagcgggtacatccttagtgacaacagatccagaagcaatcactgcgttatcaccgattgtcactcccgggttaatcaccgcccggcctccaatccaaacttgatctccaattgtcacaggcttaccgaactccttcccggatttcctttcgatcggatcaagaggatgaccggccgtgtagatatgtacacctggcgcaatcaaacaatgacggccgatacgcacctcacacacatctaaaatgacacagtcaaaattaacaaatgtatgatctccgatatgaatgtgatagccataatcacagcggaatgtcggcaaaatcgtgacttgatccccaaccgaaccgagcagctccttcaaaagctctgtccgcactatatcatcttccggtgtttcgttatattgtctaatcagctgtctcgcatgcttgcgttctagtaatagttgttgatcttccgaattgtataattctccggctgccattttttctttttctgtcctcagcatttaagtcactccatgtcagattgtaatctcgatcaaatttccttcatcatcctcaatcacactttcatagtagccgtctcctgttgtccgcgggccgttgacgacggcaaaaccatccgccttcaaccgagcagtcagttcatccactttctcccggctcccaacggaaaaggcaatatgtgcccagcctgtcattgtttgtgagggcggatcggtcacatttccttttttcataatctccagccttgctccggaaccaaacgtaataaaataagacttaaaatcttttttctcattatgatacaaatcattcgcttcgccattaaaatacgattcataaaaagacttcattcgctctaaatcattgacccagaccgctgtatgttcaatctgcatttcttcctcctccttcgccttcaatgaagttataaggtatgaaatgcatttcagttcaagcttttttcttaaatttatgctgaattttgatatcagcgggttcatcctgcaaaaatagagaaaatgctgcgatgccgagctgctcaagattcaaatcaagcgacggaaaaccaagaacacggctgatagaagtatttccctcgcctatgatttcaacatcccaattactctttttggcaaatagatgaattccagctgccacttcatcactatttgcataaatagcagtcggaaccctcccgctcatataaaaatgttcagctgcccgctcaccatcattcatatcgttgcatccggacagcatatggcggtcttccaaccttccgcagacagctttataggccgcagctttatcagccgtgctcgggctcctatcagcttctctgacacacgtaaaagcaatattctcatgcccgcggccctttaaatagcgaaagctctctgcataagcagcttttctgtcattaaaagcacaaggaacatcaatgtctccggtatcctcacaagcgatgatcggcccatattcctgataagctaaaatgctgtcccaatgattggcgcgggaagtaatgatgagaccgtctattttcttcgttcttaacagctctaaatatttgatttcaatatcggggttataattggtggggagaagggtcgttgcatactcatactgaaaagccgccttggtgattccgttaacgattttatcaaagcagggatgatcgctataaggcagaatcacaccgaccgtatgggttttcccgcgaatgagatcgattgcggttcgatttggcgtataatccaattccttcatgacttgatgaacaagctttctcttttcttcagatacataaggatggtgattcaatacacgcgagacagtcgaaacagatacatttgccagtcttgcgatctcttttatatttgccatctctttctccttttcatataaaaaaagcagtaagtgtaaaatccttactgctatctcatcatatattgatgataagttcaacaggacaatggtcggaacccatgacgtccgctgatatgcaggcatcttcaatctgttccttaagtctttcagaaacaacaaaataatcaatccgccatccgatatttctgtcccgggcgccggcacgatacgaccaccaggaataagcgccttcaagatcaggataaacatgacggaaagaatcaacaaagccagcttctaagaaacgagtgaatgcccctctttcttgatctgaaaatccagcgttattccggttcacctttggatttttcaaatcaatctcctgatgggctacattcaaatcaccgcataaaatcactggttttttctgatccaattcaagaatataagacaataaagcctcttcccattgcatgcggtaatcaatccgctctaatccccttctggaattgggcgtataaacagtcatcacatacacgttttcaaattccagcgtaatcactctgccttcttggtcatgctcttctactccgataccgtagatgacctgcagcggttcttgcttagaaaaaacagctgtgccggaatatccttttttcactgcataattccagtacacatgatagccttcaggctggagatcaacctggccgtcctgtatcttcgtttcctgaagacatataatatctgcatcctcttctttcaaataagagaggaaatccatttttctcatcacagcccgcaggccgtttacattccatgaaatcaacttcatgtttcatcctcccccctataaaaaagagcaagaacccgaaggtccttgctctttacgcatcagcttactcaccgcttacgtatggaagtaaagccatttgacgtgcgcgtttgatcgctgcagtcaatttacgttggtatttagcgtttgttccagttacacgacgtggtaaaattttaccgcgctcagaaacaaactttttaagaagatctacatctttgtagtcgatgtgcgtgataccgttagaagtgaaataacacactttacggcgtttcgcacgaccgcctctgcgtcctcctgccattgtcatttccctcctttctttttcattttaggcgataatcacattagaatggaagatcatcatccgagatgtcaatcggtttgccgtcgttggcaaatgggtcatcattaaagctgttcccctgattgcgtctctggttgttttgatttcccccaaatggattatcattttggcctccgccaaagtactggcctccgccgctgtttccttcgttgtatccacctgaaccagaaccgccgccgtttttcggctcaagaaattgaacactttcagcttggacctctgtcacgaagacacgctgtccttgctggttttcatagtttcttgtttgtaaacggccatctacgcctgcaaggcttccttttttcaagaagtttgcaacgttttcggcttgtcttctccaagtgacacaattaatgaaatcggcctcacgttctccggactggttcgtaaatgtacgattcacagcaagagtaaacgtagcaacagccgcaccgtttggcgtataacgaagctctgggtcttttgtcagtcttccgactaatacaactcggttaagcataagaaagaccaccttttaccattatatatttcaaaattgcttattcttcttctttaacaacaatgtggcgaatgatatcgtcactgatcttagctagacggtcaaattcttgaactgccgcagcgtcagattgaacgtttacgatttggtagaaaccgtcgcggaaatcgttgatttcgtaagcaagacgacgtttaccccaatcctttgttccagtgatctccgcaccgttagaagtcagaacgttgttgaaacgctcgataactgcttttttagactcttcgtcaatgtttgggcggataatgtacataacttcgtactttctcatctgtttgcacctccttttggactaagcggcccataatgggcaaggagcaataattctattactcacaattttatattataccaaagctcttgtccctttacaactgcatcctatacattaaatcggaaatgaataacatctccgtcttggaccacatattctttcccttcaaggcggacttttcctgcctctttagctcctgccataccgccgcccgcaagaagatcctcataagcaactgtctcagcacgaatgaagccccgctcaaagtcactatgaataattcctgcacactcaggtgctttcatgccttttttgaatgtccaagctctgacttcctgttctccggctgtgaaatatgttgcgaggccgagaagagagtaagacgctttgatcagctgatcaagacctgattcttgaatgcccagctcttccaagaacatttgcttttcttcgccttcaagctcagcgatttcagattcgatttttgcacatacaacgataacttctgcgttttcgccggcagcgtactcgcgaatcttcgctacattttcattgccagatggatcagcaacttcatcttcacttacgttggccacgtacaaaataggcttcgaagtcagtaaatggagctgcttcacaagcttttgctgctcctcagtgaattctacagatcgagcaggcttttcactctcaaacgcttctttcagtttagataaaatctcaaactcaaatacagcgtctttatctttttgcttcgcaagcttgctgacgcgtgtaatccgcttttcaaccgtttccatatcagcgaggatcagctcaaggttgatcgtttcaatgtcatcaatcggatcaacctttccggaaacgtgtgtaatgttgtcatcggaaaaagcacggacaacgtggcaaatcgcgtcaacttggcgaatatgagataggaacttgttgccgagtccttctcctttagatgcgccctttacaatccctgcaatatcagtgaattcaaaagcagtcggcacagtcttcttcgggttgaccagctcagtcagcttttgcagacgatcatccggcacctctacaattcccacgttcggatcaattgtacagaacgggtagttggctgattcggcaccggcctgtgtaattgcgttaaatagtgttgattttccgacgttcggcaaaccaacaattccagctgttaaagccattctttcatctcctctatataaaaccgtcattgtatgaacgtattttgaacctagagcaattataaggaggttcactggaaaagacaagctgacaaaaaagcattttcagcctgccaatccctttgattatgcttttttcaagcctactaaacagtcaaaaagcgtacttcccattccattatcagaatttgtatcatttgtcagtgcattgactgaccctccaaaagccgcccacatgccttcatctatattaatcgtcttcgcatgagcctgcttcatcactttcaccttgcccttcaagcgtccgcggtcattaaagataacaacttcgtctccattctgaagatcctgctcagccgctatatctggagaaatatcgacctgaacgtgctgaagcttttcaataaacggcacatgctgtgaatggttggaacgctgcggatgaatggataacagcgtataagggtacttttcagctaactcctcattatggaaaacagattcttcgggcacatttaattgaagcgagccgctaaatcctttttgctcagctagcgacgaagtaaattcaaattttccactcggcgtcaaaaactgataatcatcccacggcacctgttttactggaagagggaggtggcctttttcttttaaacgctcaagtgtcacatcctctgcttccaatgaagaaagccccatctctaaaaattcttgagtgctgtattcaaacagctcgccaaatccaaggcgttttgcaagctctgaccagatccagctgtccgacttcgcttcaccctgcggctccacaagcttcttcccgtactgaacataatgatgatacatactggaatagtagatatcttcttcttcaaaaacagtggcagtcggcaaaacataatcacacagctttgcggtatctgtcataatggaatcaatcgcaaccgtcatgggaaccttttcaaaagcttgtctcaccttatttgtattcggcacctgagtcagcggatttccgcacgtcacaataatcatctcaatcgcaggatcagcagcggtcaacacttcttcagcctgcgtcatcattgaaaaagaacgtgatgttgtttttaattccggcaacgtcagctttgtttttgcaaagctctcgccaatctggacatttccgaaattcgcgccgccgcccttaattccgacatttccgcttgccgcaacgagtgcatcaatccaacgaatcgttcccccgccgtttttatatcgctgcatgccaagccccataaaagtagacaccggaccatcagcatacaaaccggccagatactccagctcctccatagaagtttctgttttcacaataaactcttccagagaaacagttttcaaaagctctttcacatcatcaaaaccgacagaatgctcagaaataaacgtttcatccgttcttcccgtctcaatcagaaccttcaaaacggctgccgcaagccagccgtccattccaggctttacagagatatagcggtcagcaagcttagcagtcgggttgaagatcggatcaatcaccgtaatcgtggcgcccttctttttcacctgctgcaagtgatggtataagtgcatatttgttctggatacatttcttccccacacaacaacatgcttgctgttgtaaatatcaagcgggccgtgaccgtacgaacggccaaaatcccagctttgcgcctcgatgccggagccccagcatatgcttccgacgatttcagtcacgcctccatatccattaaaaaaacgctgatcaagcgcttttaacagaccgttattcgcataatcatggctgtgcaaaacagcagtcgtctccgacgtttccttgatttcccgaagtttatcggcaatttcatcaagtgcctgctcccaagaaatccgcacaaactcgccattttgttttttcattggatagcgaagccgatcaggcgaatttgtttttgtctcaagcattctgccgcggccgcagattttaccttccgtaatcggatggtttggatctccgtccacttttgttacctttccatcaacaacagtcaccaaaaagccgcagctgtcccaacaattcagcggacatgccgactgatgcactttgctcatcgccgtcttctccttaccttctatatgaaaaagcatgagtgtcggcctatttatgaagtaggctcctcatgcttgactagtactttttttagttttctttcaaattctcttctcggaatcataacactgtgagagcatccctcacacttaattcgaatatccattcccatgcgtataattttccagctgttcgctccgcatggatgcggttttttcatttctacgatatcattcaggccaaagtctttatccgccaagacccttcacctcttttcctaaactgctgtatctattgtacaaaaaaactgatcataagagcaatcaagatacccgaaaagaaatacatcctcttatttccatttactcaaaataggatataagagcagacaaactaacaaatacaaattgagcatcccatatatcggatacaagaacgcgatcaaatcagaaaatccgaaagaagtaaaaggcaccattaacactaacaaaatcaacacaatcacccatctcggcatatgaataaacgccatcagccggctggacagccccagcaaaccagctaccgtcgtcgtgtaaatcgccaggcacagcaccgccgtcatacataaaaaaaggaaataaggcgcaccctccagaacggcaaacagcggtatttcaaactgagaaagggagcccgccagctccaccaacgtttcattataaacaaatgagatcacgccaaaaataagaccgcttgccacacttgcgatttttgcttctccgagccctttcatctctttcccaacagaggataaaatcgcaacaactgaaaggatgtttaaagaggtaaacgtaatgctcgcaggccagttatactgctgggacaaatcaatcgtccacgtatggtgatgtgtgctctgaaaggagatcagcgcatataaaagccccgctactaacacaggaatcaaaatactatttatagataatattcctttcacatcccacaaaaacaaacacactgtcacgatgcaaatcagcgtgattccccaccagaaaggaagcttgtacatttgcagggtcacaccgcctccggcaatcatcaccatagtcgtcgaaaacaaataaaaaatgatgaggacatcataaattttcgccagccatggccccattaaatgctccagaaccggcagaaaatgagtggattgaactttaaaactgattttcatcacaatataagacgagaaaatgaacatgattgtaaacagcacaatagcaagtccgctttccgccccaaaaaactgccatatctcctgaccgctcgcataaccggccccgatcaggctccctaatatgagcagcatccacttcattccggctctccacaacactatcacctcatagacaaagttcagcttgtttccgttattgttactatataaataaaagaaagcaaacatgccatattttcatagacatttaaatacaaggtgaaattatcatacgaaatacacataaaaaaagactgctaatggaggcagtctaaaaatatatcatcttgcagtggaatgaaggaatgaacctcattaaccattcctatctataaagtgttttgtaagcaaaccgtagcttgatcatgatcgaggcaatgggggacaatatttataattcacccactaaccattcataataacctctacttttttaaaatctccggtgtcatacacaaagcataaaaaaccgtactgctggatatactgtaaacaaccttacataacgaaacacacaccatagcaattctgttacctactataacaaggaagtgaaacctatgaatcgaaaaggcgggcttttttcctctcaggaacgagtaaaacaatatgtttcacatacagatgcagctgcagcaaaacaaatccaaaccattctttcttcatccttacgtaaagctgccggcaaaccaattgttgtggtttgtatcggaacagaccgttcaaccggtgattcattgggcccactcgtaggaatgaaactcaaacagatgcagctcaccagattccatgtctacggaaccttatctgaccccgtccatgctgtgaacatgaaggataaaatcaatgacattcataaattacataaaaacccatttgttatagcggtcgatgcatgcttaggccgcgttaagagtgtgggttcatttcaaatcggggacgggccattaaagcccggagccggtgtacaaaaagaccttcctgaagtgggagatcttcatattaacggaatcgtgaatgttagcggtttcatggaatattttgtattgcaaaatacaagactcaacttggtcatgaatatggccaatgttctcgcggaaggattgagtttaacagatcggacagagtggaggcaagaacgccttaacccgttgcaaaggctcactgggcgcatataaaacaaaaaccatcttcgcttgaaagatggtttcttcatttacgattctcgttcagataaaagctctaaaatccggtcaaggtcttcattagagaaaaattcaatttcgattttgccttttttcttctgtcttttaatattaactgttgttccaaaataattttggaggtaggattcccgttcttttagaaccgcatctttcacaggttcttttttctttgtttcacgtggaacattctgattcaactgctgaatcagctgctcaagctggcgaacattgagctgctccgcaatcactttttgtaccagcggttcaagcttatttttgttttttaagccaagaagcgtgcgtccatgtcccatagaaagcgtaccttcggcaataagctgctgaatattttctggcagtgtcagcagtcttaaatgattcgcaatatgcggtctgcttttcccaagacgtttggcaagctgctcttgtgtgagatctaagtgtttcaacaaggaatcatatgcctgagcctcttcaagcggagataaatcttcacgctgaaggttttctaataaagcaatttccctcattaacgcctctgataattcacggacaatggccggaactgtatctaaacctgccagctttgccgctcgaaaacgccgttcacccgcaacaatatcatagccttttaaagattttctgacgataagcggctgaagaatgccatgctgcaacacagattcttttagttcagctaatgcctcgtcatcaaagtgttttcttggctgataaggattagggcgtaaatcggcaattttaatttcttcaactgtctcttcagacaaatctacctgattaaataacgcattaatcccttttccaaggcctttagccattcgcagccacttcctttgctaaatctaaatatacttccgcacctcttgaccgcggatcgtataaaatgatgggttttccgtgactcggtgcctcactcagacggacattacgcggaataactgtcttatatactttatccctaaaatactttttaacctcttcaatcacttgaatgccaaggtttgtccgggcatcaagcattgtcagcaatacaccttcaatcattaaatcagtattcaaatgcttttgcacaaggcgtactgtatttaataactggctgagaccctccaaggcataatattcgcactgtacaggaatcacaacggaatccgaggcagtaagggcattaatcgtcagcaagcccaatgacggcggacaatcaatgataatataatcataattttgctttactgcttcaagcgctctcttcaatctcacttctcttgatattgtaggaaccagctcgatctcagcccctgcaagctgaatcgtcgcaggaatcacatccaagttctctactgtcgttgctttaataatatctattacatctgcatcatctactaaaatatcgtacacacactgctctacatcggctttttcaatccctaatccgcttgtcgcatttccctgcggatcaatatctaccagcagaacccttttccctatgtaagccaaacatgccccaaggttgacagacgtcgttgttttgccgaccccgcctttttggttcgtaattgctatgatttttcccacgatgtcacctactttcacatgaacatgtactatcttgcttctattctatcaaaaaaagattaaagcgtttcatttttttcatcattttgttccgaatcagaagggaaataattgaaaattcaagcacgctttatgctttctcttataaattctgcaatttctatgtttttttgacttaaaaaaggaatttcttaaagaaaaaaagaagaagtcacggtacagaacgtggaaacaggatggtgagaaaatgatttatcaaacgaagagagatgtacccgttacgctgatgattgtgtttctcatattactgatacaagcagatgctattgttccttttgtgctgggaaatatgagagtttccggctggatcatttttattctgctgactcttttaaatggactcatcatttggagctttattgacctaaaatatgtattgaaggaacaccatctgatcattaaagccggattgatcaaacatcaaattccttatgaaaacatcgataaagtcgttcaaaaaaagaaactgtggtccggttttcgtctgatcggctctcgccatgccatcacaatatattatcaggggggatggggacatgcagtgatttcaccgcaaaaatctgaagaatttatccccaagctcaaagaaaagaattctaatataataatattcactaaaagtaagtgattaccttttatttaaaatataaaaagctctcctgcttttcaggagagcttctattttggtatgcgaatcgttaattgaatatattcttcaaattcttcttcttccgtattcaattttacaccgctgtcttccaccattgatagtgactggcgaatcgtgttcatcgcaattcttgtatctctgctgaatgctttgcgtctcggctttggctttctcttgccttgctccagcattttcaccacgcggtcttccgtctgctttacatttaaacttttctcaataatctctgtgagcagtgtgacttggagctcaggctgtttcagcggaatcagtgctctggcatggcgctcggtgattttcttctccataattgcctcttggaccggctgaggcagctttaataaccgaagcttattcgcgattgtagactgcccttttcctaagcgctgtgcgagtgcctcctgtgttaaatcatgcagctcaagtagcctagcataagcatgcgcttcctcaatagaagacagttcttcccgctgcaagttttcaattaacgccacagaagcggtttccgtgtcggaaaaatccttaataattgccggaatcttttcccactcaagcgattgcaccgctctccagcgtctttcacctgcaatgagttcgtattggccttcttcttctgtatgcctaacaacaatcggctgaataatgccgtgtgtatgaatggtcattgctaactctttgattttttcatctgagaaaatggtgcgtggctgaaaacggttgggaacgatagcatttaccggtatttccagaatctcttctttgtttgtatcatgttcagcaatctccggctccggttccttctcaccaagcccgaagaaacgagagaatgaatgcttcatgtacctacaccacctttaaaaactgccatttttataattctattttctcatggtttttcctgctgtacatccatcaattttgatgaaaatatgatggtattgtcatatcaggctgtctaaattacccttcaattggcgatttattaggagttcccggttttcttggatacttcttaggtgtattttttattttgcgtatcaccataatattacgatcgctttcttcaataggcagcttaaaagaatggatattctcaagttctcctccaagcgtcgtgattgcttttttgcctgcattcagttcttcttcagctgatgcggcttttaaagcaacaaataaaccgtttttcttcaccagaggcaagcaaagctcactcaaaacagataatctcgcaactgctcgcgctgtcacaatatcatagctttcacgcacgtctttccgttgcccgaacgtttcagctctgtcatggcagaatgttgtattctccaattgcaaagcctcagatagcttttctaaaaacgtgatccgtttattcagtgaatccacgattgtgacattgaggtgcggaaagcatatttttatcggcagacttggaaaacccgctcccgctccgacatcacaaatcgtgttcacctgattgaagtcgacataaaaagtagctgtaatggaatcataaaaatgctttaaatacacttcttttttctctgttattgaagtcagattgattttttcgttccattcaaccagcatgtcgtaatacagctcaaattgctccagctgacggggagaaagggagatccctttttccgccaaaccagaagtgaattcttcaatattcatgccgtcatcctttctattcggctatcttcgcaatgcgtccctgctctaaatacaccaatagaattgaaatgtccgccgggtttacaccggaaatgcgggaagcttgggcaacagacaaaggccgtacatttttcagtttttgacgcgcctcggtcgcaatccccttaattgcgtcataatcaattcgatctggaatttttttattttccatcttcttcagtttttccacttgctgaagagatttttcaatatatccttcatatttcacttggatttctacttgttctgccacgtcttgaggaactggcacttctggcggcgccagttttgtgactgtttcatagttcatttcaggacgcttcatcaagtctgtgccgcgaactccatctttcaattcgcttccgccaagagaacggatatattcttgattttccggagacggcttgataattacagaatgaagacgttttttctccgcctcgatcgccgcttttttcttctcaaaagccgcatagcgctcatcagaaatcaatccaatgcgatgtccgatttctgtcagacgcaaatcagcattgtcatggcgaagaagcaatctgtattccgcacgtgatgtcaaaagacgatatggctcattggttccttttgtcacaaggtcatcaatcagaacaccaatataggcgtcagaacggcttaaaatcacttcttcttttccaagcgcttttcgtcctgcattgattcccgccataatcccttgtcccgcagcttcttcataaccggaagttccgttaatttggcctgcagtgtaaaggtttgtgattttttttgtttcaagtgtcggccagagctgtgtcggtacgattgcatcatactcgatcgcatagccggctctcatcatttgcacgttttcaagtccaggaatcgttgcaagcattctttgctgtacgtcttctggaagacttgtagataaaccttggacatagacttcctgtgtatttctgccttccggctcaaggaagatttggtgacgcggtttatcattaaaacggacaactttgtcttcaatggatgggcagtatcttgggcccgtacctttgatcataccggaatacatcggtgaacggtgcaggttgctgtcaataatctcatgtgtctcagggcttgtatatgtcagccagcaagggagctgatctgtgatatattccactgtttcatatgagaaagcgcgaggcacatcgtcaccaggctgaatttccgttttgctgtaatcaatcgtgtcgcttttaacgcgaggcggcgtacctgttttaaaacgaacaaggtcaaaaccaagttcctccaaatgctcagaaagcttaatagaaggctgctggttatttgggccgcttgagtaagacagatcgccaagaataatacgtcctcttaaatatgtccctgtcgtcatgacaactgctttcgcacgataatgtgcaccggtttgtgtaataacgcctcggcattcgccgtcttcaacgatcagccgctccacaattccttgcagcaatgttaagtttggttctttttcaagcgtatttttcatttcgtgctgatattggaatttgtctgcttgcgcacgcaatgcacgaaccgcaggaccttttcctgtattcagcattctcatttgaatatgcgttttatcgatgtttcttcccatttctccgccgagcgcgtcaatttcgcggacgacaatcccttttgcggggccgccgacagacggattacatggcataaatgcaaccatatctaggttgatggtcaagacaagcgttttggcgccttggcgtgcagatgcgagggcagcctcaacaccggcatgcccggcgccaatcacaatcacatcgtattggcctgcttcataccccatgattctagttcctccttttattattttcctaaacagaattgtgaaaagagctgatcaattaagctttcgtggacagaatctccaatgatttcccctaaaagctcccagcatcttgtaaggtcaatttgcaccatgtcgatcgggacatcctgttcgatgccgctaagcgcatcttcaatggcgcgttttgcttgctgtaaaatagagatgtgacgtgtgttgctgacataagtcagatcaccgctttcaatggcacccgtgtagaacagtgattgaatcgcttcttccagatcattgatgccttcctcttttaaaagagatgtcgtaacaactggacgtccattggcaagctcacggacacgttcagtgtcaatcttcgcctcaaggtcagtcttattcaaaatcacgataacatccatgccctcaacggcttcaaaaagcttcacgtcttcatcagaaagctcttcactataattaagcacaagtaaaatcaggtccgcttcctttagaacctggcgagaacgttcaacaccgattcgctcaacaatatcctctgtttcacgaatacctgctgtatcaaccagacgaagcgggacgccccttacattcacgtattcctcaatcacatcccgtgtcgttccgggaatatcggttacaatggcttttgcctcatgaacgaggctgttcagaagagatgattttcctacgtttggccggccgataatgacggtagaaagaccttcacgtaagatttttccttgctcagaagtcctcagcagcgtctcaatttcctttttcacggcggttgccttttcgactaaaatctgatgcgtcatttcctctacatcatcatactccggataatcgatattcacctcaacatgggccagtgtttctaaaatctcactgcgcaaacggcgcaccaaagcagaaagacgcccttccatttgattcatagcaacgttcattgcccggtccgttttcgctctgattaagtccataaccgcttccgcctgtgaaagatcgattcggccgtttaaaaacgcacgtttcgtaaattcaccaggctctgccagtctcgctccctctcttaatgcaagctgaagcacttggttcacagtcacaattcccccgtgacagttaatctcaatgacatcttctcgtgtaaaagttctcggtgcttttaacactgataccattacttcctcaacgacacgatccgaaggtctgtctacgatatgaccataatgaatcgtatgtgattcgaccgagctgagtgttttccccttcggtcccttataaattttatctgcgatttgaatggcttctggtccgctcaaccgtacaatcgcaatcgcgccttctcccatcggtgtggaaattgccgcaattgtatccatgttgttcacctctctttacttatacttcatctatataaaaaaatttttattatgccaaaactaaaagataacatagtttggttcgaagtggaagatttgttatccacagaaatagaaattcgtcccttattactttaacttatccacatgtgaataacaattaattttatttcctgaacttcctttttatcaacaggatacacctaaaaagaaaaaacttaaacggcaaaaccttgatattactaggaaaagtagatttttcggatacaaaaaaaccgaaatccaatttttatcggacttcggttttatgctatcttttatgggaaataacgagatgacgattttcgccttcacccattgaatatgttttgatctggtggtttgcatatccagaaagagtatcgtgaataatttttctttcgctggacggcatgggctcaagctggatggattttttcgttttcaaaacctggtcagcaagcttgatggccagctggctcagtgtttcttttcttttcaaacgatagttttctgcatccaccgtcacatttttatattggcctggataacggttaagggcaagctgtgtcaaagtttcaagggcgtttaaggtttgtcctcttttcccaatcaacaatgctgccttttcacctgttatatgatatctcactgtctttttgctttcttgaacagtcacatcagacttcccggcaatggcttcggcaatcgtttgaagatataacttcgcttgctgaatcggatcaatcttttcaaccagctttacgatcgcaggctttttaccgaaaatgccgagaaaccctttgtttccctcttcaataacagtaatttctaccttatccttcgttaatcccagctcttgcaatccggactgtactgcttcatcgacatttcgccctgcagcagtcacattcctcactttttctttcctccggctttttgcggctcaggattttttttaatatcaggtcctttaatgaggaaagtttgcgcaatcataaacaagttaccaactacccaataaagagaaagagccgccgggaagttgatcgcaaatacgataatcataattggcataatccaaagcatcatcgccatttgcggattttgctgcgcattgccagccatcatcagtttttgctgaacaaatgtagcgacaccggcaacgataggaagaatatagtaaggatctttttctcctaagtcaaaccataagaagctatgctctgaaatcgcctgggttctcatgatcgcatgatagaatccaattaaaatcggcatctggatcaaaatcgggaaacatcccgccaatggattgacaccatgcttttggaataaagccattgtttcctgctgaagcttttgctgcgttttttgatcctttgagctgtatttttctttaagcttttgcatttccggctgtaaagcctgcatcgctttcgaacttctcagctgcttaatcatcagcggtaaaattaataaacgaattaaaatggtaactagaattattgaaagcccgtagttatctcccgtcaatttcgctacatacgtaatgagctcagacaatggatatactacgtacttgtcccagaaatgcggactatctgcagtgatcggctctttcacactcgagcatccagccaaaagcatgaatacgccaaccatacttaatagcaaccctattctccttttcaacaacatttcctcctataattaatctttacactcttttattgcaaagcatacttgtatgtattttagcatctttcagttttaaatggtgtctttttctgatcaaccagaaaggaagcgcttttaaaagttgtaagaaagcagtggtgatgcctactttgacgaagatttcttatataatgaagactttctgaatagatgctgcagactttttttcgtttcctcatatgtcagctggctcgccggttttctggcaataatgatgtaatccttttccttcagtctctctttctcctcaagaaaggcctgccgaatcaaacgtttgatccgatttcgcatcacagcattgccaatttttttgctgacggaaagcccgacacgcagttcatcattttcaggctgatcaagcgtatataagacaaactggcggtttgcaactgatgtcccatgtttaaacactttttgaaaatcttcatttttctttaaacgatttcgcttcttcaaatgactcactccgatactggctggcagaaacttttaaaatttattatgaacatgagatgcatctgaaccaggaagcatgccccggttcattacgcatcacatctatcttttcccataacgtgaaaaaagaccactgacattattcagtggcctaagctgataatacttttctgcctttgcggcgacggcgtgctaaaactagacgaccgttttttgaactcatacggcttctgaagccatgaactttgctgcgtttacggttattcggttggaatgttcttttcatttatgacacctccctcgaggaatagctgttaaagacagtcttacttattatatttgcgttacctattcattgtcaacttcactagtgcttttatttcttgcaaccataataggataccataccttttcaactttcgaaaccttattttttagattccttaattttacggaaaaaagacaaattcaaacaatttgcccctaaaatcacgcatgtggatatctttttcggctttttttagtatccacagaggttatcgacaacattttcacattaccaacccctgtggacaaggttttttcaacaggttgtccgctttgtggataagattgtgacaaccattgcaagctctcgtttattttggtattatatttgtgttttaactcttgattactaatcctacctttcctctttatccacaaagtgtggataagttgtggattgatttcacacagcttgtgtagaaggttgtccacaagttgtgaaatttgtcgaaaagctatttatctactatattatatgttttcaacatttaatgtgtacgaatggtaagcgccatttgctctttttttgtgttctataacagagaaagacgccattttctaagaaaaggagggacgtgccggaag
